United States Patent 8,937,220 (ISOLATED POLYNUCLEOTIDES AND POLYPEPTIDES, AND METHODS OF USING SAME FOR INCREASING PLANT YIELD, BIOMASS, VIGOR AND/OR GROWTH RATE OF A PLANT) - sequence listing, part 2

SEQ ID NO: 1552 - DNA, 2043 bp, Gossypium hirsutum
  misc_feature (492)..(492): n is a, c, g, or t
  misc_feature (495)..(495): n is a, c, g, or t
  misc_feature (828)..(828): n is a, c, g, or t
  misc_feature (861)..(861): n is a, c, g, or t
cctctctctctctcttcttaccgaccgttttcctgcctggtcgccgtttagttttctaaaccgaggttgccggagagtccattttctccgacatttcttccttctcaaaagatctcttcttttgagacttgacttccggttttgttgattgaagacaaagaaatggaagggactaaagagatggggcttagaaatgtgagctcaacgtgctcaatcaacgaaatggatgattatgatctctcacgtcttcttgataagccaaggcttaacatagagaggcaaagatcatttgatgagaggtcactcagtgagctctctattggtctcaccagagcaggtcttgacaattacgagaccacatactctcctggtgggaggtcaaggtcaggtttcgatactccggcttcatcgactagaaactcatttgagccacaccccatggtggctgaagcatgggaagctctcaggaggtctttggtgtatttcagagancanccagttggtaccattgccgcatatgaccatgcttccgaggaagttttgaactatgatcaagtttttgttcgagattttgtacccagtgctctggcgtttctgatgaacggagagcctgatatagttaagaactttctcttgaagactctacaacttcaagggtgggagaaaagaatagatagattcaaactaggagaaggtgctatgccagctagcttcaaagttcttcatgaccctgtacgaaaatcagacacaattattgcagattttggagagagtgccattggaagagttgcaccagttgactctggattctggtggatcattctgctncgtgcatatacaaaatctactggggacttgtcnctagctgagacacctgagtgtcagaaaggaatgaggctcatactcactttgtgtctgtcagaaggatttgatacattcccaactctactttgtgctgatgggtgctctatgattgatcgaagaatgggtatttatggttatcctattgaaattcaagcacttttctttatggcgttgaggtgtgctttatcaatgctaaagcatgatgcggaaggaaaagaatgcattgaaagaatcgtgaaacgcttgcatgccttgagttatcacatgcgcagttacttttggcttgactttcaacaactaaatgatatctacagatataaaactgaggagtattctcacactgcagtaaataagttcaatgttattcctgattctatcccagactgggtatttgactttatgccaacacgaggtggctactttattggcaatgttagtcctgcaaggatggatttccgatggttttgtttaggtaactgtatagcaatactatcttctcttgcaactccagagcaatcaatggctattatggaccttattgaagcccgctgggatgaacttgttggagaaatgcctctaaaaatagcttatcctgcaatagaaagtcatgaatggcgaattgtcactggctgtgaccctaagaatacaagatggagttatcacaacggaggatcatggccagtgctgttgtggctgctaacggctgcttgcatcaaaacgggaaggccgctgattgcaagacgtgcgattgatcttgccgagacacgtttgttcaaagatagctggccggagtattatgacgggaagctcgggagatatattggtaaacaggctaggaagtaccagacatggtcaatagcaggatatttagtggcaaaaatgatgctggaggacccatcacacttggggatgatttcattggaagaggacaaacagatgaagccattgctaaagagatcatcttcctggaattgctaaacaaaacaaaaacaaaacagggaaaaagagctttaaaaattttcattataacaatattcttttttatttggcgctgctcctctatttagggtttcataaaaagaaaactttgcttttttctgtactgtagcaggttgctaagacttaatctcttgccttctcttcagaaaagaaataaataaaagacacattttgctgttc

SEQ ID NO: 1553 - DNA, 2257 bp, Gossypium hirsutum
  misc_feature (1714)..(1714): n is a, c, g, or t
  misc_feature (1734)..(1734): n is a, c, g, or t
  misc_feature (1745)..(1746): n is a, c, g, or t
  misc_feature (1749)..(1749): n is a, c, g, or t
  misc_feature (1775)..(1776): n is a, c, g, or t
  misc_feature (1779)..(1779): n is a, c, g, or t
  misc_feature (1804)..(1804): n is a, c, g, or t
  misc_feature (1814)..(1814): n is a, c, g, or t
  misc_feature (1827)..(1829): n is a, c, g, or t
  misc_feature (1832)..(1832): n is a, c, g, or t
  misc_feature (1845)..(1845): n is a, c, g, or t
  misc_feature (1867)..(1867): n is a, c, g, or t
  misc_feature (1872)..(1872): n is a, c, g, or t
  misc_feature (1885)..(1885): n is a, c, g, or t
ttttgttgattgaagagaaagaaatggatggggctaaagagacgggacttagaaatgtgagctcaacttgctcaatctcggagtcagatgattatgatctgtcacgcctccttgataagccaaggcttaacattgagagacaaagatcatttgatgagagatcactgggtgagctctctattggtctcgcaagaggcgctcatgacaactatgagaccacgcactcgccaggttggaggtctggtttcaatactccggcctcatcggctagaaactcctttgaaccccaccccatggtggctgatgcatgggaagctctcaggaggtctttggtgtatttcaaaggccaaccagttggtaccattgccgcatatgaccatgcttccgaggaagttttgaactatgatcaggtttttgttcgagactttgtacccagtgctctagcttttctgatgaatggagagcctgagatagttaagaactttctcgtgaagacccttcatcttcaagggtgggaaaaacgaatagatagattcaagctaggggaaggtgcaatgccagctagcttcaaagttcttcatgatcctgtgcgcaaatcagacacaattattgcagattttggagagagtgccattggtagagttgctccagttgactctggattctggtggatcattctgctccgtgcatataccaaatctactggggatttatctttagctgagacacctgaatgtcagaaagggatgaggctcatacttactctttgtctatcagaaggatttgatacattcccaaccctactttgtgctgatggatgctctatgattgatcgaagaatgggtatttatggttatcctattgaaattcaagcacttttctttatggcattgaggtgtgctttatcaatgttgaaacatgatgctgaaggcaaagaatgtattgaaagaattgtgaagcgtttgcatgctttgagttatcacatgcggagttacttctggcttgacttccaacaactaaatgatatttatagatataaaactgaggagtattctcacactgcagtaaacaagttcaatgttattcctgattccatcccggactgggtgtttgattttatgccaacacgaggtggctactttattggcaatgttagtcctgcaaggatggatttccgatggttttgtttaggtaattgtatagcaattctgtcttctcttgcaactccggagcaatcaatggctataatggaccttattgaggcccgttgggatgagcttgttggagaaatgcctctaaaaatagcttatcctgcgatagaaagtcatgaatggcgaattgtaactggttgtgaccctaagaacacgagatggagttatcacaatggaggatcttggccagtgcttttgtggttgctgacagctgcttgcatcaaaacgggaaggccacaaattgcaagacgcgcaatagaccttgctgagacacgcttgttgaaagatgggtggccagaatattatgacggcaaactcgggagatatgtcggtaaacaggccaggaagtatcagacatggtcaatagcaggatatttagtggcaaaaatgatgatggaggatccgtcgcacttggggatgatttctttggaggaggacaaacagatgaagccattgataaagagatcatcttcttggacttgctaaaaaaaggaaaaaaaaancagaattgggaaatggaaanagaccaacttnnganttttcattgtaccggtaccagtcttnnttnttttacgttatgtttccaagtcaanaaaatagtgncaaaaaaaaaaannnaanttttgcagccatngctgatggctcatgcattgttnatttncattccaagtatncattaaaaggaagttaagtttcccccggtagccaaatgccctatttctaaaaaaaaaaaaaaaaaaaaaaaaaaaaaaaaaaaaaaaataaaaaaaaaaaaaaaagaaaaaaaaaaaaaaaaaaaaactctcaagaagaaattttttaaagagggggcgccggggccccatgaaaattttcccccccgggggggggggagaccagaaaaaggggtaccccaattttcccccctaaaaagggaggccaaaaattaaaaaatatctggggggcgcctcttttttataaaaccgtctggagagggggaaaaaaaccccgggggggtgttccccacactctaatataactcccctttttggcacccaccccccccc

SEQ ID NO: 1554 - DNA, 1685 bp, cucumber
gaaatggatgggttcggacttcgaaatgtgagctctcattgctcgatctctgagatggatgattacgatctttctcgtcttcttgataagcctaagctcaatattgagaggcaaagatcatttgacgagagatccctcagtgagctgtccatcggccttgctagaggaggcctggacaactttgagagctcatattcacctggtggaaggtcaggatttgataccccagcttcatcttcccgaaactcgtttgagccccacccaatgatcgctgaagcatgggaggctttgcgtagatccatggtgtatttccggggccaaccagttggaaccattgcagcatatgaccatgcctccgaggaagttttgaattatgatcaggtttttgttcgggattttgttccaagtgctttggcatttctgatgaacggggaacctgacatagttaagaacttcctgctaaagactctgcagcttcagggatgggaaaaaagaattgatagattcaagcttggggaaggtgcaatgccagctagctttaaggttcttcatgatcccgttagaaaaacagataccgttgctgctgattttggagaaagtgcgataggaagagttgctcctgttgactctggattctggtggatcattctgctccgtgcatatacaaagtcaacaggtgatctatctctggctgaaacatcagagtgtcagaagggaatgagacttattttaactttatgtctgtcggaggggtttgatacattcccaactcttctttgtgctgatggatgctccatgattgatcgaagaatgggtatatatggttatcctatagaaattcaagcccttttctttatggccctgagatgtgctctggctatgctgaaacatgatgctgaaggaaaagagtgcatagagcgtattgtgaagcgcttgcatgccttaagttatcacatgaggagttatttctggcttgatttccagcaactaaatgacatctaccgttataaaacagaagaatattctcatacagctgtaaataagtttaatgtcatcccagattcaatcccagaatggttgtttgattttatgcccacacgtggcgggtactttgttggtaatgttagtcctgcaagaatggactttagatggtttgctttaggtaattgtgttgcaattctaggatctcttgccacccctgagcaatcaatggctattatggatcttattgaatcacgctgggaagagctggttggagaaatgcctttgaaaatatcatatcctgccatagaaagtcatgagtggcgaattattactggttgtgatccgaagaataccaggtggagctaccataatggtggatcttggccagttctactatggctgctaacagctgcttgcattaaaactggacgaccacagattgctagaagagccattgagctggcagagagtcggttgctgaaggatagttggccagaatactacgatggaaagttaggaagatatatcggaaaacaagcgaggaaataccagacatggtcgatagcaggatacttggtcgcaaagatgatgttggaagatccatcacacttggggatgatatcacttgaagaggacaagcaaatgaagccactgatcaagagatcatcatcttggacctgttaggccaaatgaagaaagag

SEQ ID NO: 1555 - DNA, 2142 bp, Lotus japonicus
ttttttcccttcttcttctctctcctccgctttaaccttccgcccaccattctccggcgaaatcgccggccatccaccgccgtttacgccggacaatcttcctccctccgccgccatcctccttcagagttaatatcgagttctgatattcggagaatttgagagagaatggacgggcctgtgggacttaagaaaatcagttctcagtgttccatccctgagatggatgatttcgatcaactctcgcgtctgcttgacaagccgaggttgaacattgagaggcagaggtcgtttgacgagaggtcactcagcgagctgtcgcaaggttttgctagggcaggggtggataactatgagaactactcgcccggagtgagatctgggtttaacacgcctgcttcgtccgcgcggaactcttttgagccgcaccccatggtcgctgatgcctgggaatccctccgaaggtctctagtgtattttaaaggccagcccgtcggcaccattgctgctgttgatcatcaagcagaggaagttctgaactatgatcaggtttttgttcgagattttgtgccaagtgctctagcctttttgatgaatggtgaaccagatatagtcaggaacttcttgttgaagacactgcatcttcagggctgggaaaaaagaatagatcgatttaagctaggtgaaggtgtgatgccagctagtttcaaagtccttcatgatcctgttaggaaaacagatactcttattgcagattttggtgaaagtgcaattggaagagttgctcctgttgactctggattctggtggatcattttgcttcgtgcgtacacaaagtctacaggggatttaactttggctgaatctccagattgtcaaaagggaatgaaacttatattgactttgtgcttgtcggaagggttcgatacattcccaactctgctttgtgctgatggatgctccatgattgatcgaagaatgggtatttacggctatcctatagagattcaagcacttttcttcatggcattgcgatgtgctttgtcaatgctgaaacaggatgatgctgaaggaaaggaatgtgtggagcgtattgtgaagcgtttgcatgcactaagttatcacatgcgaggttacttttggcttgatttccaacagctaaatgacatttatcggtataagactgaggagtattcccacactgcagtaaataagtttaatgttattcccgattcaatcccagaatgggtatttgactttatgccaacacgcggtggctactttattggaaatgtcagtcctgcccgaatggattttcgatggtttgctttaggcaattgtgttgcaattctatcatctttagcaaccccagagcaatcaatggctatcatggatcttattgaagctcgctgggatgaattggtaggagaaatgccactaaaaatatcttatcctgcaatagaaagtcatgagtggcgaatagttactggttgtgatcccaaaaataccagatggagttaccataatggaggatcttggccagtgctgctgtggcttgtaacggctgcttgcatcaaaacggggcgaccacagatagcaagacgtgcaattgagcttgctgagagtcgtctattgaaggacgggtggcctgaatattatgatggtaaacttgggagatatgtaggcaagcaagcaagaaagtaccaaacatggtctattgcaggttatctggtggcaaagatgatgctggaggacccctcacacttggggatgatttcccttgaagaagacaagcagatgaaaccagtgattaaaagatcatcctcttggacttgctaaaagatttcaggtgatagataaatagtacaaaaaaaaaaagaatagagaaaaacttagaaggtgagagatattgttgtttcgatacggaactattctttgtgattcccttcctcgttggcctgattgaaagtttagctttgtgtaaaatagctgctgcttgagactggcatcatgcttttccaaaataattgagactcttttcagttcatgtttgataaattccatgctattgcccccctttctggctgttgccagggattattagtaagataactgaaagtataatgattcttcattgaattt

SEQ ID NO: 1556 - DNA, 2368 bp, Zea mays
ctataaatacgccttcacaaccagctgatctttttttcccctctttccgcgttcccaccctgccgtcgttgctactcgcatcgagatttgcgcggccgtgtcttgctcgcgcctgctgctctgttgccccccttccttccaaggtcgcgtcagcgcccagatctctcgctcgctcgccggcgccccggctagatctgggcggagctcggaggcggagccgtgcgccagtgtccaagtttggtaagacccaaagcggtgaggaggcgagggaagacgcgcggacgccatggagctggctgtcggcggcgggatgcggcggtcggcgtcgcacacctcgctgtcggagtcggatgacttcgagctcacgcggctgctcagcaagccgcggatcaacgtcgagcgccagcgctccttcgacgaccgctcgcttagcgacgtctcgcactcgggcgggtacggcaggggaggcttcgacggcatgtactcgcctgggggcggcctgcgctccctcgtcggcacgccggcctcctccgggctgcactccttcgagccccaccccatcgtcggcgacgcctgggaggcgctccgccgctccctcgtcttgttccgcggccagccccttggcaccgttgccgccgtcgaccacgcgtccgaggaagtcctcaactacgaccaagtgtttgtgagggatttcgtgccgagcgcgctggcgtttctgatgaatggcgagccagatatcgtcaagaacttccttctgaagaccctgctgctgcagggctgggagaagaaagtcgatcggttcaagctcggggagggagccatgccggctagcttcaaggttatgcatgacgccaagaagggggtcgagaccctacatgctgattttggggagagcgccattgggagggttgcgcctgtggattcggggttctggtggatcatactcctccgggcctacacaaaaaccaccggtgatttgacgctggcagagacgccggagtgccagaaagggatgaggctcatactcagcctgtgcttatccgaggggttcgataccttcccgacattgttatgtgctgatggttgctgtatgatagatcgcagaatgggtgtatatggctaccctattgagattcaggcccttttctttatggcactaaggtgtgctcttcaaatgcttaagcatgataatgaagggaaggagtttgtagagaagattgctactcgccttcacgctttaagttatcacatgcggagttatttttggctcgatttccaacagctaaatgacatctatcgttacaagacagaagaatattcccacactgctgtcaacaaattcaatgtcattcctgattcaattccggattggctatttgacttcatgccttgtcagggtggttttttcattggtaatgtcagtcctgccaggatggacttccgatggttcgcacttggaaacatgattgctatactttcttcccttgcaacacctgaacaatctgttgctataatggatcttattgaggagcgttgggaagagctcatcggtgaaatgcctctgaagatatgttatcctgctattgagaaccatgaatggcgaattgtgacgggctgtgatccaaaaaatactagatggagttatcataatggaggatcgtggccagtacttctgtggctgctgactgcagcctgcatcaaaactggacggccacaaatcgcaagaagggcaattgacctagcagaaaggaggctgttgaaggatggctggcctgagtactatgatgggaagcttggtcggtatgttggcaagcaggcgaggaaattccagacctggtccatcgcggggtatttggtcgccaagatgatgttggaagatccttcacatctcggcatgatctccctggaagaggatagggcaatgttgaagcctgttttgaagcggtctgcgtcatggacaaactgagatggccacaaaaatttttagggaagcaaagtctgctgaaaacacgagttcttgggggtagcatctccttgtctgctgatccgtttcctttgacttccaaacatggatggtttgtgtcttctggattttccttggttgtacaatatctcagctcgttttctgagttgaaagaaaaagaagcaactgcagaaatgggcattttgtttttttctttcgcaatctctgtaagaagatactctgattcttgcttgggtcatcctataagttgtggatccttttggttagagtcaactttgttgtgccagtggattatacgggtgagtaagctgattccagcttccctgtgaagcataagtgctctttctaacgaatgaataaagctcatttctctgtgttgctgga

SEQ ID NO: 1557 - DNA, 2073 bp, Zea mays
gcgcccgagcagagagagcctgactctgcagctatacgagctcagactccctctcctccctcctttctcttaccttcctcgtgagacatcaccgccgtctcggtacgtggcagcaaccaaccgttcgcttctctctcctggagcgtcgcgcggggcccggcgggggaccgtacgtacctgtgcgcgaagacggggacggtggcggagttcgagatggaggcggcgccgatgcgaaaggcgtcgtcgcaggcgtcgctggcggacccagacgacttcgacctgacgcgcctgctgaaccacaagccgcggatcaacgtggacaggcagcggtcgttcgacgaccgctccctcggcgagatatcgctcgccggcgcgggcacggccagccgcggtggctggggctacggcggcggggggatggagagctacgagagcatgtactcccccggcggcgggctgcggtcctactgcggcacgccggcctcgtccacgcggctctcgttcgagccccacccgctcatcggcgaggcctgggacgcgctgcgccgctccatggtgtccttccgcggccagccgctcggcaccatcgccgccgtcgaccactcctccggcgaagtgctcaactacgaccaggtgttcgttagggacttcgtcccgagcgcgttggcgttcctgatgaacggggagccggagatcgttcggaacttcctgctgaagacgctgctgctgcaggggtgggagaagcggatcgaccgcttcaagctcggcgagggcgccatgccggcgagcttcaaggtgctcaaggacccgaagcgcggcgtcgacaagctggtggccgacttcggggagagcgccatcggccgcgtggcgccggtggattccgggttctggtggatcatcatcctgagggcctacaccaagtccaccggcgacatgaccctcgccgagacgcccatgtgccagaagggcatccggctcatcatgaaccagtgcctcgccgagggcttcgacaccttccccaccctgctctgcgccgacggctgctgcatgatcgatcgcaggatgggtgtgtatgggtacccgatcgagatccaggccctgttcttcatggcgctgcggtgcgcgctcctcatgctgaagccggatgcggaggggaaggagatcatggagcggatcgtgacgcggctgacggcgctgagctaccacatgcggagctacttctggctggacttccagcagctcaacgacatctacaggttcaagacggaggagtactcgcacacggccgtcaacaagttcaacgtgaacccggagtccatcccggactggctcttcgacttcatgcccacccgcggcggctacttcgtcggcaacgtcagccccgcccggatggacttccgctggttcgcgctcggcaactgcgtcgccatcctcgcctcgctcgccacgcccgaccaggccgccgccatcatggacctcatcgaggagcgctgggaggacctcgtcggcgagatgcccgtcaagatatgctacccggccatcgaggggcacgagtggcagatagtcacgggctgcgaccccaagaacacaagatggagctaccacaacgggggatcttggccagtgctgctgtggctgctcaccgcggcatgcatcaagaccgggaggctgaagatcgctcggcgcgcgatcgacctagccgaggcgaggctcgcgagggacggctggccagagtactacgacggcaagctgggtcgctacatcggcaagcaggcgaggaagctccagacgtggtccatcgcggggtacctagtggccaagatgatggtggaggatccgtcccacctcggcatgatctccctggaggaggagaagccgaccaagccggtgctcaggaggtcggcctcttggacagggtaaggtagtggcgggctggcggccacaaagacggcagcaggacccgagttctggttctttgagctaacatctcgaatttctctgcaacttcttgctttccggctggggaagtaggcgtgtccaatgttttggtgggtctcccatgtatgaatcttt

SEQ ID NO: 1558 - DNA, 2225 bp, Medicago truncatula
gcactcttatttcctatatccaatccaatttcgaatatctcggagtagtagatagaaacatttatatacaccaaaccaaaacggcgtcgtattgcctacgtggactccgccggtaaccataaccggctatatcaagtaaaaacatttctacctccgtcttcgcctataaatataaccttcccacctcattctcattttttcccttcccctactaatttctctcccattttctctcctttttccggcgatttcgccggccaaccaccgtcgtttcagccggagagatctcacttcgccgaaccgttccattcctccttcagataatatctctttctgataaagtaaattggagagaatggatgggcatatgggaattaggaaagtcggctctcagtgttcgatggctgagatggatgatttcgatctcactcgtttgcttgacaggccgaggctaaacatagagagacagagatcatttgatgagaggtcgcttagtgaattgtctgttggttttgcaagggctgggttagataactatgacaattactcgcctggaggaagatctggttttaacacccctgcttcatctgctcgcaactcgtttgagccgcatccaatggttgctgatgcctgggaatctctcaggaaatctctagtccatttcagaggtgcacctgttggcacaattgcagctgttgatcatcaagcagaggaagttctaaattacgatcaggtttttgttcgagattttgtcccaagtgctctagcctttttgatgaatggtgaaccggaaatagtaaaaaacttcttgttaaagacactacatcttcaggggtgggagaaaagagtagataggtttaaacttggggaaggtgtgatgccagctagtttcaaagtcctgcatgatgccgttaggaaaacagatactcttattgcagattttggcgaaagtgcaatcggaagagttgctcctgttgactctggattctggtggatcattttgcttcgtgcttacacaaaatctacaggggacttaactctgtctgaatctgatagttgtcaaaaaggaatgaagcttatattgactttatgcttgtcagaggggtttgacacatttccaactctgctttgtgctgatggatgctgcatgattgatagaagaatgggtgtttatggatatcctattgagattcaagcacttttcttcatggcattgagaagtgctttgtccatgctcaagcaagatactgctgacggaaaggagtgtgtagagcgtgttgtgaagcgtttgcatgcactaagttttcacatgagaagctacttttggcttgacttccagcaactaaatgacatttatcggtacaagactgaggagtactcacatactgcagtaaataagtttaatgttattccggattcaattccagaatgggtgtttgactttatgccaacacgtggtggctacttcattggaaatgtcagtccggctcgaatggattttcgatggtttgctttaggaaactgtgttgcaattctttcttctttagcaactccagagcagtcaatggcaatcatggatcttattgaagctcgttgggatgagttggttggagaaatgccgctaaaaattagttaccctgcaatagaaagtcacgagtggcgaattgttactggctgtgatcccaaaaataccagatggagttaccataatggaggatcttggccagtactcctgtggcttgtaacagctgcttgcatcaagacagggcgaccacaaatagcaagacgtgcaattgaacttgccgagagtcgtttactgaaggatggatggcctgaatattatgatggtaaacttggaagatatgttgggaaacaggcaagaaaataccaaacatggtctattgcgggttatttggtggcaaagatgatgctggaggacccctcacacttggggatgatttcccttgaagaagacaagcagatgaaaccagtgattaaaagatcatcttcttggacttgctgaaatattggtgatagataaatagtacaaaaaagaaagagaatagagaaaacttagaaggtgagatattgttgtttctctcaatacacggcactattctttgtgatttccttcttcgtaggcctgatttgattggaagtttggcttgtgtaaaatagctgctgctggcatcatgctttttcctaataatcaaagacatttcaat

SEQ ID NO: 1559 - DNA, 2149 bp, Quercus alba
ttttattttttatttttttcctcctcctcctccgaccaccacggagtgccggcgaactcgccggcgataaaacgacaccgtttattctcctcctcatccttcctatttgagcttcgctcttcgccttctatactatactctctccctccctctccttatttggatcttttgtctcttttcagatctggttgttcagagttcgattttcgagggagagagagagagagagagagtaagagagatagtggagtgggagcaaagagatgggagtaggtgtgggacttagaaacgtgagctcgcattgctccatctcggaaatggacgactacgatctctctcgtcttctcgataagccgaggctcaacatcgagaggcagagatcgttcgacgagaggtcgttgagtgagttgtcgatcggtctagccagaggaggattagataactttgagagcacgtgctcccccggaggaaggtccgggtttgataccccggcttcttcggctcgtaactcattcgagcctcatccaatggttgctgacgcttgggaggctcttcgccgctctttggtgtattttcggggtcagccggttgggactattgctgctgttgaccatgcctctgaggaagttctaaactacgatcaggtttatgtacgagattttgttcctagcgctctggctttcctgatgaatggtgagcctgacatagtcaagaattttctcttgaagactttgcaccttcaagggtgggaaaaagaatagacagatttaaacttggggaaggtgcaatgccagccagcttcaaagttcttcatgaccctattcgaaaaacagatacacttattgcagattttggtgagagtgccattgggagagttgctcctgttgactctggattttggtggataattctgctgagagcttatacaaagtccacaggggatttaactcttgcagaaacatcagattgtcaaaaggggatgaagcttattttaactttatgtctgtcggaggggtttgatacattcccaactctgctttgtgcagacggatgctctatgattgatcgaagaatgggcgtatatggttatccaattgaaattcaggcacttttctttatggcgttgagatgtgctttggcaatgcttaaacctgatacagaaggaaaagaatttatagagcgaattgtgaagcgtttgcatgcattgagttatcacatgcgaagttacttttggcttgacttccaacagctaaatgacatttaccgctacaagactgaggagtactcacatactgcagtaaataagtttaatgttattcctgattcgatcccagaatgggtatttgattttatgccaacacggggtggttactttattggaaatgttagtcctgcaagaatggattttcgatggtttgcattaggcaattgtgttgcgattatgtcatctcttgcaacacctgagcaatcaatggctattatggatcttcttgaatctcgctgggaagagttggttggagagatgcctctgaaaataagttatcctgcaatagaaagtcatgagtggagaattgtaactggttgtgatcccaagaataccagatggagttaccataatggaggatcttggccagtgcttttgtggctgctgacagctgcttgcattaaaacgggacggccacaaattgcaagacgagcgattgagcttgctgagaatcgtctgctgaaggataactggccagaatattatgatgggaaaactgggaggtatattgggaagcaggcaagaaagtaccagacatggtcaattgcaggatatttggtggcaaagatgatgctagaggatccatcacacttgggaatgatttcactggaagaggacaagcaaatgaagccagctcttaagaggtcgtcatcttggacttgctgaaaagctcaagcaagtaaaagcaaataggagaaaaagaatagagaaaaagaggtggtgaaacatcttgttatataaatcaatactattctttggtgcttcctgccttgtacggcttcattcaaagtttgcttgtgtacaatagcctgtgctgaaactagttttgtgaatttccaaataaaagatgcattttgttattcaaggtataaactttgggaggac

SEQ ID NO: 1560 - DNA, 2187 bp, Populus trichocarpa
ctctctctctgctgtgtctttgccttttctttctctcttcaccgaccatttgccggcgaaatcgccgtcgccggagggattcattatccgtcatttactctttgcaaagaaacaaagctttctctgtagtattcaaggattgagagagaaaaacaaatggatgggactaaagagatgggggggcttaggaacgtgagctcagtgtgttcaatatccgaaatggatgattttgatctctctcgcctccttgacaagccaaagttgaacatagagaggcagagatcgtttgatgagaggtctctaagcgagctctcgatcgggcttgcaagaggaattgatacctttgagaccacatattcacctggtggaaggtcagggtttaacacaccagcctcatcaactcgcaactcgtttgagcctcaccccatggtggctgatgcgtgggaggctctacggaggtctttagtttacttcagaggccaaccggttggtactatagcagcatatgaccatgcctcagaggaggtcttaaactatgaccaggtttttgtacgagattttgtacccagtgccctagcttttctgatgaatggtgagcctgacatagtcaagcacttcctgttgaagacactgtatctccaagggtgggaaaagagaatagatcgattcaaacttggggaaggggcaatgccagcgagctttaaagttctccatgatcctattcggaaaacagactctcttgttgcagattttggtgagagtgctattggaagagttgctccagttgactctggtttctggtggatcattcttcttcgagcatatacgaagtctactggagatttatccctggcagagagaccagagtgtcagaagggaatgaagctcattttgacgctctgcttgtcggaggggtttgatactttccctacccttctttgcgccgatggatgctccatgattgatcgcagaatgggtatctatggttatcctattgagattcaagcactttttttcatggcgttgagaagcgctagctcaatgttgaaacatgatcaagaaggaaacgaatttattgagagaattgtgaaacgtttgcatgccttgagctatcacatgcggagttacttctggcttgactttcaacaactgaatgacatatacagatataagactgaggagtattctcacactgctgtaaataagttcaacgttattcctgattcaatcccagattgggtatttgatttcatgccaattcgtggaggctactttattggcaatgttagtcctgcaaggatggatttcagatggtttgctttaggtaattgcattgccattctgtcttctcttgcaacccatgaacaagcaatggctatcatggatctcattgaagctcgctgggaggagctggtaggagaaatgcctctgaaaatagcctatcctgcgatagaaagtcatgaatggcgaattgtaactggttgtgatcctaagaataccagatggagctatcataatggaggatcatggccagtgcttttatggttgctgactgctgcatgcatcaaaacgggacgaccccaaattgcaagaaaagcgattgatcttgctgagacccgtcttctgaaagacggctggccagaatattatgatgggaaacttggcagatatgttggtaaacaggcaaggaaataccagacatggtcaattgctggatacttggtggcaaagatgatgctggaggacccttcacacttggggatgatttctttggaagaggacaggcaaatgaagcctgtgctcaggagatcatcttcttggacttgctaggggggcatgatatagaaaaagaaaagaaaagaaaagaatagggaaagaacacggaaggtgagaatgcggggtttcattacagcaccattctttggcgtttgtcctcgtaggtttgattggacttttggttttgtgtacaatagtttctgcaaagaccatgccctgcttttcaaataagagatgcattttgctgtgtttcaaaagtttttgaatggcatcttcgaaatgccgtaatcggttcatattagcttgtgacaccagcaatggaacaagatttgtgttaattgccgatcaaggactggaaaaagttccatgaaatacagacttttggattcaaatttgatgcatccttactgt

SEQ ID NO: 1561 - DNA, 2116 bp, Populus trichocarpa
atatctctctctcctactcgtgtcttctccttttctttctctcttcaccgaccgtttgccggcgaaattgccgtcgccggagagattttccaccagtcattttctcattgcgaagaaacaaagcattttctgtagcaatcaagtattgaaagagaaaaacaaatggatgcgactaaagaaacggtggggcttatgaatgggagctcagtgtggtcaatatccgaaatggatgatattgatttctctcgcctctctgacaagccaaagttgaacatagagaggaagagatcatttgatgagaggtctcttagcgagctctcgatcgggcttgcaagaggaattgataactttgagaccacgaattcacctggtggaaggtccgggtttaacacgccagcctcatctgctcgcaactcgtttgagcctcacccaatggtggctgatgcatgggaggctctacggcggtctttagttttcttcagaggccaaccggttggtactattgccgcgtatgaccatgcctcagaggaagtcttgaactatgatcaggtttttgtacgagactttgtacccagtgccctagcttttctgatgaatggtgagcctgaaatagtcaagcaattccttctgaagacactacatctccaaggatgggaaaagagaatagatcgattcaagcttggtgaaggggcaatgccagccagctttaaagttcttcacgatcctattcgaaaaacagactctctggttgcagattttggtgagagcgcaattggaagagttgctccagtggactctggtttttggtggatcattctgctccgagcatatacaaagtctactggagatttatctctagcagaaactccagagtgccagaaaggaatgaggctcatattgacgttgtgcttgtcagaggggtttgatactttccctacccttctatgtgccgatggatgctctatgattgatcgcagaatgggcatctatggttatcctattgaaattcaagcactttttttcatggcattgagaagcgcttgctcattgttgaaacatgacgaagaaggaaaagaatgtattgagagaattgtgaaacgtttgcatgccttgagctatcacatgcggagttacttctggcttgactttcaacaactgaatgacatatacagatataagactgaggagtactctcacactgctgtaaataagttcaacgttattcctgattcaatcccagattgggtatttgatttcatgccaactcgtggaggctactttattggcaatgttagtcccgcgaggatggattttagatggtttgctttaggaaattgcattgccatcctgtcttctcttgcaactcatgaacaagcaatggctatcatggatctcattgaagctcgctgggaggagctagtgggagaaatgcctctaaaaatagcttatcctgcaatagagagtcatgaatggcgaattgtaactggttgcgatcccaagaatactagatggagctatcataatggaggatcttggccagtgcttttatggttgctgactgctgcgtgcatcaaaacgggacgaccccaaatcgcaagaaaagcgattgatcttgctgagacccgtctactgaaagacagctggccggaatattatgatgggaaacttggcagatacattggtaaacaggcaaggaaatatcagacatggtcaattgctggatacttggtggcaaagatgatgctggaggacccttcacacttggggatgatttctttggaagaggacaagcaaatgaatcctgtgctcaagagatcatcttcttggacttgttaaagagggcattcaagcgaaggatataaaaagaagaataagaagaggtaaagaccacggaaggcaagaaatgtggggtttcattacagcaccattctttggcattttgcccttgtaggtttgatcaaactttcggttttctgtacaatagtttctgctaagaccatgccctgcttttctaataagcgatacattctgctgtttgtgttgcaaacattttgaatggcatattggaagtggcataattgatttatattaaggacgtttgacaataaaaatggag

SEQ ID NO: 1562 - DNA, 2363 bp, Oryza sativa
gcccgcttcgcctccccccgaattaacaaaaaaaaaaccctcctcgcctaccccccaccgacgtgtgggccccactcccccggccccacccgtcatacaccccgggtgtacggacccccgccggaatcccgcaccgccggcgatatatagtaggggagctcgaggcagctagattttttttttctccccatcgagattcgcgtggccttgtggtcaccgccgccgccgccgcctagatctctcgctgcgtctctccctccctcccctccggcgatccgcgtagatctgggcgggaggcggcggagatccgcggcgaggaggggagggaggggaagcaagcaagcaaagcggaggggcatggagctggcggtgggagcgggcgggatgcggaggtcggcgtcgcacacgtcgctgtcggagtcggacgacttcgacctgtcgcggctgctgaacaagccgcggatcaacgtcgagcggcagcgctcgttcgacgaccgctcgctcagcgacgtctcctactccggcggcggccacggcggcaccaggggcggcttcgacggcatgtactcgccggggggtggcctgcggtcgctcgtcggcaccccggcctcctccgcgctccactccttcgagccccaccccatcgtcggcgacgcctgggaggcgctccgccgctcgctcgtcttcttccgcggccagcccctcggcaccatcgccgccttcgaccacgcctccgaggaggtcctcaactacgaccaggtgttcgtgagggatttcgtgccgagcgcgctggcgttcctgatgaacggcgagccggagatcgtgaggcacttcctgctcaagacgctcctgctgcagggctgggagaagaaggtcgatcggttcaagctcggggagggcgccatgccggccagcttcaaagtgctccatgactccaagaagggcgtcgacaccctgcatgcggatttcggggagagcgccattggcagggtggctcccgtggattcggggttctggtggatcatacttctacgggcatacaccaagtccaccggggatctcacgctcgcggagacgccggaatgccagaagggaatgaggctgatactgagcctgtgcttgtctgaggggtttgataccttcccaacattgctgtgtgcagacggttgctgcatgatagatcgcagaatgggtgtttatgggtaccctattgagattcaagccctgttctttatggcactaaggtgtgctcttcaattgcttaagcatgataacgaagggaaagagtttgtagagaggattgcaactcgtcttcacgctctaagttatcacatgcggagttactattggcttgatttccagcagctaaatgatatttatcgctataagacagaggaatattcccacactgctgtcaacaaattcaatgtcatcccagattctattccggattggttatttgattttatgccttgccagggtggttttttcattggtaatgttagtcctgcaaggatggacttccggtggtttgcacttggaaacatgattgctatactatcatcccttgctacacctgagcaatcaacggccataatggatctcattgaggagcgatgggaagagcttattggtgaaatgcctctgaagatatgctaccctgctattgagaatcacgaatggcgtattgtgacaggctgtgatccgaagaatactagatggagttaccacaatggaggatcttggccagtactactatggctgctcacagcagcctgcatcaagactggccggccacaaattgcaaggcgtgcaattgacttagctgagagaaggctgttgaaggatggttggccagagtactatgatgggaagcttgggcggtatgtcggcaagcaggcaaggaaattccagacttggtctatcgcagggtatttggtcgccaagatgatgcttgaggacccttctcatctcggaatgatatcactagaggaggataaggcaatgaagcctgttttgaagaggtctgcctcatggacaaactaagatgtcgacgaaaatttttagggaagcaaagtcagtttgggaacaaaaattcttttggtagctcttctctgctcatccctccgtttgacttttcgaaccggaaaggtttgtttcatctggatttcccggttgtacaatatgtcagcccatttcttagctaaaaagaagcaattgcggaaatgggtgttttggtttcaatccctgcttgtaagaagattcctgctttgggtcaaaaatcttaaagctgattccagtttcctggtcttttgatggagagaagtgctactctaacgaataataaaagctcatttttctgc

SEQ ID NO: 1563 - DNA, 2032 bp, Solanum phureja
tcccctcttcttccattttctacttagccccttcttctctctccatttctctcttttttttccggtcatctcgccggcttcagactccattattgccggcagaatactaccttttttttctctctcagctaaggttttaagagtgaggatggaaggtactggattgagaaatgttagctcccactgctccatttcggagatggatgactttgatctctcgaaacttcttgataagccaaggattaacatagagaggcagagatcttttgatgagaggtcgctaagtgagttatccataggcttatctagaggtttagataattatgagaatacttactcgccaggaaggtctgggttggacaccccagcttcatcggcacgaaactcttttgagccacatccaatggttgctgaagcctgggatgctctacgccgttccatggttcactttcgaggccaaccagttggtacaattgctgcagtggatcatgccgctgaggaagtcctcaattatgatcaggtctttgttcgggattttgttcctagcgctctggccttcctgatgaatggagagcctgatatagttaagaacttcctgttgaagacacttcagcttcaagggtgggagaaaagagtagatagattcaagctgggggaaggggttatgccagctagtttcaaggttcttcatgatcctgttcgtaagacagatacgataatggcagattttggtgagagtgcaattggaagagtcgctccagttgattctggattttggtggataattcttctccgtgcatacacaaaatctaccggagatgtaagtcttgctgaaactcccgagtgccaaaggggaatgaggcttatattgagcttatgtttgtctgaaggatttgatacatttcctactttgctttgtgctgatggatgctcaatgattgatagaagaatgggaatctatggttatcctattgagatccaagcactcttctttatggcattgcgaagtgctttggcaatgttgaagcacgatacagaagggggagaatttgttgagagaatagtgaagcgtctacatgccttgagttatcacatgagaagttatttctggcttgatttccaacaattaaacgacatttaccgctataaaactgaagaatattctcatactgcagtaaataagtttaatgttatccctgattcaatcccagattgggtatttgaatttgtgcctaaacgtggtggttactttattgggaacgttagtcctgcaaggatggacttcagatggtttgctttaggtaactgtattgccatattgtcctcccttgccactccagagcaagcttccgctattatggatctcatagaagcacgctgggacgagctagtagcagagatgcccttaaaaatatcttatccagcactagaaaatcatgactggcgacttataactggttgtgatcccaagaataccaggtggagctaccataatggtggatcttggccagtgcttttatggttgctaaccgctgcctgcattaagacgggacggccacaaattgcaagacgagcaatagatcttgctgagagccgcttatctaaggactcctggcctgaatattatgatggtacagttggaagatatattggtaaacaagcgaggaagtatcagacatggtcaatcgcaggatatctcgtagcaaagatgttgctggaggatccttcgcatttgggaatgattgccttggaagaggacaagcaaatgaagcctgtaatcaaacgatcagcttcttggacgtgctgaagtgctgagttgaagaaagagatttaagtacaaatgattagagaaagccacaaggtgagagcaatcttttgttattttgttacaagaacactatttttttggctcctattcccatccttgtaatattgctcttaatttttatcgtgtactcttgcatccagcgagaccaatgtctcgtttatccgtataaaagacctcgtttgatggttcccttgtttgaaagtt

SEQ ID NO: 1564 - DNA, 2153 bp, Solanum phureja
actctttctctctctttatctggcgatctcgccggcgctccggccatcatcatcgtcggaaaaatctcccttcttctcatttctctctctagctaagagtgcttccaacgattgaaggtttaaggtgaccatggaagaaactggactgagaaatgtgggctcgaactgctccatttctgaaatagatgattatgatctctcgaagcttctaaacaagccaaggctaaacatagagaggaagagatcttttgatgagaggtcactcagtgagttatccattggcctatctagaggtttagatcattatgaaagtgcctcaccaggccggtcagtcttggacaccccagtttcatcagcccggaactcttttgagccccatccaatggttgctgaagcatgggacgctctacgccgcactatggttcattttcgcggtcaaccagttggcacaatagctgcaattgaccatgcctctgaagaagtcctcaactatgatcaggtttttgttcgagattttgtgcctagtgctttggccttcctgatgaatggagagccagatatagtcaagaacttcttgttgaagacacttcagcttcagggatgggaaaaaagagtagatagattcaagctgggagaaggggttatgcctgctagtttcaaggttcttcatgatcctgttcgtaagacagataccatagtagcagattttggtgaaagtgcaattggaagagttgctccagttgattctgggttttggtggataattcttctccgtgcttacacaaaatctactggagacctgagtctctctgaaacaacagagtgccaaaaggggatgagacttatattgagcttgtgtttgtctgaaggatttgacacatttccaactctgctatgtgctgatggatgctcaatgattgatcggaggatgggtgtttatggatatcctattgagatccaagcactcttcttcatggcactgagatccgcattggccatgttgaagcacgatacagaagggaaagaattcattgagagaatagtgaagcgcctgcatgccttgagttatcatatgcgaagttatttttggctcgactttcaacagttaaatgacatatatcgctataaaactgaagagtattctcacactgcagtaaataagtttaatgttattcctgattcaatcccagagtgggtatttgattttgtgcctacacgtggaggttactttattggaaacgttagtcctgcgaggatggacttcaggtggtttgctttgggtaactgtattgccatcttgtcttcccttgccactccagaacaagcttctgctattatggatctcatagaagcccgctgggaggagctagtagcagatatgcctttgaagatatgctatccagcaattgaaaatcacgaatggcggatagtaactggttgtgatcccaagaatattagatggagttaccataacggaggatcttggccagtgcttttgtggttgctaacggctgcctgcattaagactggacggccacaaattgcaagacgggcaattgatcttgctgagagccgcttactcaaggacagctggcctgaatattatgatggaaagctcggaagatacattggtaaacaagcaaggaagcaccagacgtggtcaattgctggatatcttgtagcaaaaatgttgctggaggatccttcacacttgggaatgatctctttggaagaggacaaacaaatgaagcatgtaatcaagcgatcatcttcatggacgttctgaggtgttgagttgaagcaagagacaaacagtagaaacggatagtgaaacacagaaggtgagacatgttttttgttaacattacaagaaacacaattctttggctatttctgtccttgtaggtttgctcaaaagttccctttgtgtaaattagcattcatccagccagatcaatgtcttgtttttcttaaaataagagacttttgttttgatagtttccactgtgttggaccaattttagattatgatcatctaattgttttgacaaagacagtgaatatgatgtttcctaactatatatatattgattgttgcctaaattgaaccaaacttattgatacaattttatcccttgttgtaacttaacaaa

SEQ ID NO: 1565 - DNA, 2370 bp, Sorghum bicolor
ttcccctctctttccgcctcccagtcccagtccccaccctgccggcgtcgtcgtcgctactcgcatcgagattcgcgcggccgtgtcttgctctgctctgcttggtcccccccttccctcctccctcggtcgcgtcagcgccccagatctctcgctcgccggcgcccgggctagatctgggcgggagctcggaggcggagccggagccggagccggccgggcgcaagtttggtgagacacaaggggggaggagtaggaggaggcgagggaagaccgccgcggacgttgcgccatggagctggctgtcggcggcgggatgcggcggtcggcgtcgcacacctcgctgtcggagtcggacgacttcgagctcacgcggctgctcagcaagccgcggatcaacgtcgagcgccagcgctccttcgacgaccgctcgctcagcgacgtctcgcactcgggcggctacggcaggggaggcttcgacggcatgtactcgcctgggggcggcctgcgctccctcgtcggcacgccggcatcctccgcgctgcactccttcgagccccaccccatcgtcggcgacgcatgggaggcgctccgccgctcactcgtcttctttcgcggccagccccttggcaccgtcgccgccgtcgaccacgcttccgaggaagtcctcaactacgaccaagtgtttgtgagggatttcgtgccgagcgcgctggcgtttctgatgaatggcgagccggatatcgtcaagaacttccttctgaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggagggttgcgcctgtggattctggtttctggtggatcatactcctccgggcgtacacaaaaaccaccggtgatatgaccctggcagagacaccggagtgccagaaagggatgaggctcatactcagcctgtgcttatctgaggggtttgataccttcccgacattgttatgtgctgatggttgctgtatgatagatcgcagaatgggtgtatatggataccctattgagattcaagcccttttctttatggcactaaggtgtgctcttcaaatgcttaagcatgataatgaagggaaggaatttgtagagaagattgctacccgccttcatgctttaagttatcacatgcgaagttatttttggctcgatttccaacagctaaatgacatttatcgttacaagacagaagaatattcccacacagccgtcaacaaattcaatgttattcctgattcaattccggactggctatttgactttatgccttgtcagggtgggtttttcattggtaatgttagtcctgccaggatggacttccgatggtttgcacttggaaacatgattgctatactttcttctcttgcaacacctgagcaatctgttgctataatggatcttattgaggagcgttgggaagagcttatcggtgatatgcctctgaagatatgttatcctgctattgagaaccatgaatggcgaattgtgacaggctgtgatccaaaaaatactagatggagctatcacaatggaggatcgtggccagtacttctgtggctgctgactgcagcctgcatcaaaactggacggccgcaaattgcaagaagagcaattgacctagcagagaggaggctgttgaaggatggctggcctgagtactatgacgggaagcttggtcggtatgttggcaagcaggcaaggaaattccagacttggtccatcgcggggtatttggtcgccaagatgatgttggaagatccttcacatcttggcatgatctccctagaagaggataaggcgatgttgaagcctgttttgaagcggtccgcatcatggacaaactaagatggcgacgataatttttcgggaagcaaagtcagctgaaaacacgaattcttggggtagcatctccttgtctgctgacccccttccttgacttccaaaccgggttggtttgtgtcttctggatttttcttggttgtacaatatctcagctcgtttcctgagttgaaaaaaaagaagcaactgcagaaatgggcgttttgttttttctttccaaatctctctgtaagaagatactctgattcttgcttgggtcatcataagttatggatccttttggttagactcaactttgttgtaccagtggactatacagatgagtaagctgattccagcttccctgtgaagcataagtgctatttctaacgaatgaataaagctcctttctctgcgttgctgca

SEQ ID NO: 1566 - DNA, 2301 bp, Glycine max
ctctttctctccgttttgccattctctccgcgccccgttttccggcgaaatcgccggcgagtcaccgtcgtttccgccggacactctcttcccccgtcgccgtcctccttcagatagtatctatttttgatataatcgttccgttattagagaagttgagaaaatggacggccatatgggaatgaggaaaatcagttctcactgctctatccctgatttggatgattccgatctcttacgtttgcttgagaaaccaaagttgaacattgagagacagagatcgtttgatgagaggtcactcagtgaactctccattggtcttgcgagagcgggcttggataactatgacacttattcgccagggggaagatctggttttaacacacctgcttcgtctacacggaactcgtttgagcctcaccccatggtcgccgatgcctgggaatccctcagaaaatctctagtctattttagaggccaaccggttggcacaattgcagctgttgatcatcaatcagaggaagttctaaactatgatcaggtttttgttcgtgattttgtgcccagtgctctagcctttttgatgaatggtgaaccagagatagtcaggaacttcttgttgaagacactgcatcttcaggggtgggaaaaaagagtagatcggtttaagcttggtgaaggtgtgatgccagctagtttcaaagtccttcatgatcccattaggaaaacagacactcttattgcagattttggtgaaagtgcaattggaagagttgctccagttgattctggattctggtggatcattttacttcgtgcgtacacgaagtccacaggggatttatctttagctgaatcaccagattgtcaaaagggaatgaaacttatactgactctatgcttgtcagagggttttgatacatttccaactttgctttgtgctgatggatgttgcatggttgatcgaagaatgggtatttatggttatccaatagagattcaagcacttttcttcatggcattgagatgtgctttgtcaatgctgaaacaggatgacgccgaagggaaggaatgtgttgagcgtattgtgaagcgtttgcatgcactaagttatcatatgcggagttacttttggctcgacttccaacaactaaatgacatttatcgatataagactgaggagtactcacatactgctgtaaataagtttaatgttattcctgattcaatcccagattgggtatttgactttatgccaatgcgcgggggctacttcattggaaatgttagtccagcccggatggattttcgatggtttgctttaggaaattgtgttgcaattctatcttctctggcaactcccgagcaatcaatggctatcatggatcttattgaatctcgctgggatgaattagttggagaaatgcccctaaaaatatcctatccggcaatagagagccatgagtggcaaattgtgactggttgtgatcccaaaaataccagatggagttaccataatggaggatcttggccagtgctcctgtggctagtaacagctgcttgtatcaaaacgggtagaccacagatcgcaagacgtgcgatcgaacttgctgagagtcgtttactgaaggatgggtggcccgaatattatgatggtaaacttgggagatatattggcaaacaggcaagaaaataccaaacatggtctattgcaggttatctggttgcaaagatgatgctggaggacccctcacacttggggatgatttcccttgaagaggacaaacagatgaaaccggttattaaaagatcatcttcttggacttgctaaattcaggtgatagataaatagtataaaaaacaaatagcgaaaaacttagaaggtgagagatattgttgttttcaatacacggcactattcttggtgattcccttcctcgtaggcttgattgaaagtttggcttgtgtaaaatagctgctgctgagactggcatcgtgcttttcccaaataagtaaaaagacacttcagttcatgtttgctaagttcaatgctacccgtcccacttgttgcgtgggatttaattagtaagaagagaaattatgaaacattcttcatttttattgtgtttcctagttgtcaataaggcttctttgaaaaagggcctagaacagaaagtattagctttttcatatggaactttaggtctactgtccacattgctaaaaaaatatggtaaattatgattatttttactaattttcgtgaatacagtgtacttttcattgagtttttttggcttt

SEQ ID NO: 1567 - DNA, 2147 bp, Glycine max
atggacggccatatgggaatgaggaaaatcagctctcactgctctatccctgatttggatgattctgatatcttacgtttgcttgaaaagccaaagttgaacattgagagacagagatcatttgatgagaggtcactcagtgagctctccattggtcttgcgagagcgggcttggataactatgacacttattctccaggaggaagatctggcttcaacacacctgcttcgtctacacggaactcgttcgagcctcaccccatggttgccgatgcctgggaatccctcagaaaatctctagtctattttagaggccaaccggttggcacaattgcagctgttgatcatcaatcagaggaagttctgaactatgatcaggtttttgttcgagattttgtgcccagtgctctagcctttttgatgaatggtgaaccagagatagtcaggaacttcttgttgaagacactgcatcttcagggttgggaaaaaagagtagatcggtttaagcttggtgaaggtgtgatgccagctagtttcaaagttcttcatgatcctattaggaaaacagatactcttattgcagattttggtgaaagtgcaattggaagagttgctccagttgattctggattctggtggataattttacttcgtgcctacacaaagtctacaggggatttatctttggctgaatcaccagattgtcaaaagggaatgaaacttatactgactctatgcttgtcagaggggtttgatacatttccaactttgctttgtgctgatggatgttgcatggttgatcgaagaatgggcatttatggttatccaatagagattcaagcacttttcttcatggcattgagatgtgctttgtcaatgctgaaacaggatgacgccgaaggaaaggaatgcgtagagcgtattgtgaagcgtttgcatgcactaagttatcatatgcggagttacttttggctcgacttccaacaactaaatgacatttatcgatataagaccgaggagtactcacatactgcagtaaataagtttaatgttattcctgattcaatcccagaatgggtgtttgactttatgccaatgcgcgggggctacttcattggaaatgttagtccggcccggatggattttcgatggtttgctttaggaaattgtgttgcaattctatcttctctggcaactccggagcaatcaatggctatcatggatcttattgaatctcgctgggatgaattagttggagaaatgcccctaaaaatatcttatcctgcaatagagagccatgagtggcgaattgttactggttgtgatcccaaaaataccagatggagttaccataatggaggatcttggccagtgctcctgtggctagtaacagctgcttgtatcaaaacggggagaccacagattgcaagacgtgcaattgaacttgccgagagtcgtttactgaaggatgggtggccagagtattatgatggtaaacttgggagatatattggcaaacaggcaagaaaataccaaacatggtctattgcaggttatctggtggcaaagatgatgctggaggacccctcacacttggggatgatttcccttgaagaagacaaacagatgaaaccggttattaaaagatcatcttcttggacttgctaaattcaggtgatagataaatagtataaaaaacgaatagagaaaaacttagaaagtgagagatattgttgtttcaatacacggcactattcttggtgattcccttcctcgtaggcttgattggaagtttggcttgcttgtgtaaaatagctgctgctgagactggcttcatgcttttcccaaataagtaaaaagacacttcagttcatgtttgctaagtttcaatgctaccgtcccacttgttgcgtgggttaattagtaagataagagaaatcatgaaacattcttcattttattattgtgtttccttatagtttgtcaataaggcttcttttaaaaagggcctagaacaggaaagtattagctttttcatatgaaactttaggtctactgcccacattgctaaaaaaatatggtaaattatgatttttcttttttaccatttttcgttaatacagtctactttccgttgagtttttttt

SEQ ID NO: 1568 - DNA, 2287 bp, Saccharum officinarum
tcgcgcctgctgcgctgctctgctctgctctgcttggtcccccttccctcctccctcgatcgcgtcagcgcccagatctctcgctcgctcgctcgccggcgcccgggctagatctgggcgggagctcggtggcggagccggccgggcgcaagtttggtgagacccaaggggaggaggaggaggaggcgagggacgacgcgcggacgtacgccatggagctggctgtcggcggcgggatgcggcggtcggcgtcgcacacctcgctgtcggagtcggacgacttcgagctcacgcggctgctcagcaagccgcggatcaacgtcgagcgccagcgctccttcgacgaccgctcgctcagcgacgtctcgcactcgggcggctacggcaggggcggcttcgacggcatgtactcgcctgggggcggcctgcgctccctcgtcggcacgccggcctcctccgcgctgcactccttcgagccccaccccatcgtcggcgacgcctgggaggcgctccgccgctcactcgtcttcttccgcggccagccccttggcaccgttgccgccgtcgaccacgcgtccgaggaagtcctcaactacgaccaagtgtttgtgagggatttcgtgccgagcgcgctggcttttctgatgaatggcgagccggatatcgtcaagaacttccttctgaagaccctgctgctgcagggctgggagaagaaaatcgaccggttcaagctcggggagggagccatgccggctagcttcaaggtcatgcatgacgccaagaagggggtcgagaccctacatgctgattttggggagagcgccattgggagggttgcgcctgtggattctgggttctggtggatcatactcctccgggcctacacaaaaacaactggtgatttgacgctggcagagacaccggagtgccagaaagggatgaggctcatactcagcctgtgcttatctgaggggtttgataccttcccgacattgttatgtgctgatggttgctgtatgatagatcgcagaatgggtgtatatggctaccctattgagattcaagcccttttctttatggcattaaggtgtgctcttcaaatgcttaagcatgataatgaagggaaggaatttgtagagaagattgctacccgccttcacgctttaagttatcacatgcgaagttatttttggctcgatttccagcagctaaatgacatttatcgttacaagacagaagaatattcccacacagccgtcaacaaattcaatgttattcctgattcaattccggactggctatttgactttatgccttgtcagggtggttttttcattggtaatgttagtcctgccaggatggacttccgatggtttgcacttggaaacatgattgctatactttcttctcttgcaacacctgagcaatctgtcgctataatggatcttattgaggagcgttgggaagagcttatcggtgaaatgcctctgaagatatgttatcctgctattgagaaccatgaatggcgaattgtgacaggctgtgatccaaaaaatactagatggagttatcacaatggaggatcgtggccagtacttctgtggctgctgactgcagcctgcatcaaaactggacggccgcaaattgcaagaagagcaattgacctagcagagaggaggctgctgaaggatggctggcctgagtactatgatgggaagcttggtcggtatgttggcaagcaggcaaggaaattccagacttggtccatcgcggggtatttggtcgccaagatgatgttggaagatccttcacatcttggcatgatctccctggaagaggataaggcgatgttgaagcctgtcttgaagcggtcagcatcatggacaaattgagatggcgatgaaaatttttagggaagcaaagtcagctgaaaacacgaattcttggggtagcatctcgttgtctgctgaccccattcctttgacttcaaaaccgggatggtttgtgtcttctggaattttccttggttgtacaatatctcagctcgtttcctgagttgaaaaaaagaagcaactgcagaaatgggcgttttgttttttctttcccaatctctctgtaagaagatactctgattcttgcttgggtcattataagttatggaacctcttggttagactcaactttgttgtaccagtggactatacagatgagtaagctgattccagcttccctgtgaagcataagtgctatttctaacgaatgaataaagctcctttctctgcgttgc

SEQ ID NO: 1569 - DNA, 2139 bp, Panicum virgatum
gaagggggggagggggagggcaacagcgagcgagcgcgcgcgcgccatggagctggcggtgggaggcgggatgcggcgctcggcgtcgcacacctcgctgtcggagtcggacgacttcgagctcacgcgcctgctcagcaagccgcggatcaacgtcgagcgccagcgctctttcgacgaccgctcgctcagcgacgtctcccactcgggcggctacggcaggggcggcgccttcgacggcatgtactcgccggggggcggcctgcgctcgctcgtcggcacgccggcctcctccgcgctccactccttcgagccacaccccatcgtcggcgacgcctgggaggcgctccgccgctccctcgtcttcttccgcggccagcccctcggcaccgtcgccgccgtcgaccacgcgtccgaggaggtccttaactacgaccaggtgtttgtgagggatttcgtgccgagcgcactggcgttcctaatgaacggcgagccggatatcgtcaggaacttccttctcaagaccctgctgctgcagggctgggagaagaaagtcgaccggttcaagcttggggaaggagccatgccggcgagcttcaaggtgatgcatgacgccaagaagggtgttgaaaccctacatgctgattttggggagagcgcgattgggagggttgcgccagtggattccgggttctggtggatcattctcctgcgggcctacacaaagtccaccggggacttgacactggcagagacacctgagtgccagaaagggatgaggctcatactgagcctgtgtttgtccgaggggtttgataccttcccgacattgttatgtgccgatggttgttgcatgatagatcgcagaatgggtgtatatggctaccccattgaaattcaagcacttttctttatggcacttaggtgtgctcttcaaatgcttaagcatgataatgaagggaaggagtttgtagagaagattgctactcgccttcatgctttaagctatcacatgcgaagctatttctggcttgatttccaacagttaaatgacatttaccgttacaagacagaagaatattcgcacacagctgtcaacaaattcaatgttattccggattctattccggactggctgtttgatttcatgccttgtcagggtggctttttcattggtaatgttagtcctgcaaggatggacttccgttggtttgcacttggaaacatgattgccatactttcttctcttgcaacacctgagcaatctgcggctataatggatcttattgaggagcgttgggaggagcttattggtgaaatgcctctgaagatatgttatccagccattgagaaccatgaatggcgaattgtgacaggttgtgatccaaaaaataccagatggagttatcacaatggaggatcatggccagtacttctgtggctgctgaccgcagcctgtatcaagacgggacggccacaaattgcaagaagagcaattgacctagctgagaggaggctgttgaaggatggctggccagagtactatgatgggacgcttgggcggtatgttggcaaacaagcgagaaaattccagacttggtccattgccgggtatttggtcgctaagatgatgctggaggacccttcacatcttggcatgatctccctggaagaggatagggcgatgctgaagcctgttttgaagcggtccgcatcatggacaaattgagatggcgacgaaaacttgtagggaaacaaagtcagctgaaaattcttggggtagtatccttgtctgctgcttacccccttcctttgactttccataccgagatagtttgcgtcttctggattttccttggctgtacaatatctcagcttgtttccggagttgaaaagaagcaactgcagaaatgggcattttcttttttgttttttcaatctctcgttgtaagaagatgctctgattcttgattgggtcatcctacaagttgtggatcagttaatggatccttttggttggactcaactttgttgtaccagttgaccatacagatgagtaagctgattccagcttccctgtgaacagcacaactgctatttctaacggatgaataaagctcctttctctgcgttgctaga

SEQ ID NO: 1570 - DNA, 2008 bp, Solanum lycopersicum
cccctcttcttccattttctacttacccccttcttctctctctatttctatttttatttttctggctatatcgccggcttccgactccattatttccggcagaatactaccttttattctctcagctaaggttttaagagcaaggatggaaggtagtggattgaaaaatgttagctctcactgctccatttcggagatggatgactttgatctctcgaaacttcttgataagccaaggattaacatagagaggcagagatcttttgatgagaggtcgctaagtgagttatccatagggttatctagaggtttagataattatgagaatgcttactcgccgggaaggtctgggttggacaccccagcttcgtcggcacgaaactcttttgagccacatccaatggttgctgaagcctgggatgctctacgccgttccatggttcactttcgaggccaaccagttggtacaattgctgcagtggatcatgctgctgaggaagtcctcaattatgatcaggtctttgttcgagattttgttcctagcgctctggccttcctgatgaatggagagcctgatatagttaagaacttcctgttgaagacactacagcttcaagggtgggagaaaagagtagatagattcaagctgggggaaggggttatgccagctagtttcaaggttcttcatgatcctgttcgtaagacagatacgatcatggcggattttggtgagagtgcaattggaagagtagctccagttgattctggattttggtggataattcttctccgtgcatacacaaaatctaccggagatgtcagtcttgctgaaactcctgagtgccaaagggggatgaggcttatattgagcttatgtttgtctgaaggatttgatacatttcctactttgctctgtgctgatggatgctcaatgatcgatagaagaatgggaatctatggttatcctattgagatccaagcactcttctttatggcattgcgaagtgctttggcaatgttgaagcacgatacagaagggggagaattcgttgagagaatagtgaagcgtctacatgcattgagttatcacatgagaagttatttttggcttgatttccaacagttaaacgacatttaccgctataaaactgaagaatattctcatactgcagtaaataagtttaatgttatccctgattcaatcccagattgggtatttgaatttgtgcctaaacgtggtggttactttgttgggaatgttagtcctgcaaggatggacttcagatggtttgctttaggtaactgtattgctatattgtcctcccttgccactccagaacaagcttccgctattatggatctcatagaagcacgctgggatgagctagtagcagaaatgcccttaaaaatatcttatcctgcactagaaaatcatgattggcgacatataactggttgtgatcccaagaataccaggtggagctaccataatggtggatcttggccagtgcttttatggttgctaaccgctgcctgcattaagacgggacgaccacaaattgcaagacgagcaatagatcttgctgagagccgcttatctaaggactcctggcctgaatattatgatggtacagttggaagatatattggtaaacaagcgagaaagtatcagacatggtcaatcgctggatatcttgtagcaaaaatgttgctggaggatccttcacatttgggaatgattgcattggaagaggacaagcaaatgaaacctgtaatcaaacgatcagcttcttggacgtgctgagttgaagaaagagatttaactacaaacgaatagagaaagccacaaggtgagaggaatcttttgttgttttgttacaagaacactattttttggctcctattcccatccttgtaatattgctcttaatttttaccgtgtactcttccaacgagaccaatgtctcgtttatcagtataaaagacattgtttgatggttcctttgtt

SEQ ID NO: 1571 - DNA, 2191 bp, Solanum lycopersicum
actctttctctctctttatctggcgatctcgccggcgctccggccatcatcatcgtcggaaaatcttccattcttctcatttctctctctatctaagagtactcaggaggattgaaggtttaaggtgaccatggaagaaactggactgagaaatgtgggctccaactgctccatttctgaaatagatgattatgatctctctaagcttctaaacaagccaaggctaaacatagagaggaagagatcttttgatgagaggtcactcagtgagttgtccattggcctatctagaggtttagatcattatgaaagtgcctcacctggccaatcagtcttggacaccccagtttcatcagcccggaactcttttgagccccatccgatggttgctgaagcatgggatgctctacgccgcactatggttcattttcgtggtcaaccagtcggtacaatagcggcaattgaccatgcctctgaagaagtcctcaactatgatcaggtttttgttcgagattttgtgcctagtgctttggccttcctgatgaatggagagccagatatagtcaagaacttcttgttgaagacacttcagcttcagggatgggaaaaaagagtagatagattcaagctgggagaaggggttatgcctgctagtttcaaggttcttcatgatcctgttcgtaagacagacaccatagtagcagattttggtgagagtgcaattggaagagttgctcctgttgattctgggttttggtggataattcttctccgtgcttacacaaaatctactggagacctcagtctctctgaaacaacagagtgccaaaaggggatgagacttatattgagcttgtgtttgtctgaaggattcgacacatttccaactctgctatgtgctgatggatgctcaatgattgataggaggatgggtgtttatggatatcctattgagatccaagctctcttcttcatggcactgagatctgcattggccatgttgaagcacgatacagaagggaaagaattcattgagagaatagtgaagcgcctgcatgccttgagttatcatatgcgaagttatttttggctcgactttcaacagttaaatgacatatatcgctataaaactgaagagtattctcacacagcagtaaataagtttaatgttattcctgattcaatcccagagtgggtatttgattttgtgcctacacgtggaggttactttattggaaacgttagtcctgcaaggatggacttcaggtggtttgctttgggtaactgtattgcaatcttgtcttcccttgccactccagaacaagcttctgctattatggatctcatagaatcccgctgggaggagctagtagcagatatgcctttgaagatatgctatccagcaattgaaaatcacgaatggcggatagtaactggttgtgatcccaagaatattagatggagttaccataatggaggatcttggccagtgcttttgtggttgctaacggctgcctgcattaagactggacggccacaaattgcaagacgagcaattgatcttgctgagagccgcttactcaaggacagctggcctgaatattatgatggaaagctcggcagatacattggtaaacaagcaaggaagcaccagacatggtcaattgctggatatcttgtagcaaagatgttgctggaggatccttcacacttgggaatgatctctttggaggaggacaagcaaatgaagcctgtaatcaagcgatcatcttcatggacgttctgaggtgttgagtcgaagcaacagacaaacagtagaaacggatagagaaacacagaaggtaagagatgtgttttttttgttaacattacaagaaacacaattctttggctatttctgtccttgtaggtttgctcaaaagttccctttgtgtaaattagcatatcatccagccagatcaatgtcttgtttttcttaaaataagagacttatgttttgatagtttccactgtgttggaccaattttagataatgatcatctaattgttttgacaaagacagtgaatatgatgtttcctaaatatatatatatattaattgttgcctaaattgaaccaaacttattgatacaattttatcccttgttgtaggtaaaaacaaagctatactcgaatgaaacacttctgtaaa

SEQ ID NO: 1572 - DNA, 2251 bp, Triticum aestivum
gcggaacccccctcgcctcgagattcgcgcggccgtgtctgcctctgggtccgcgcttccgttgtctagcgtcctgagctagatctctcagctcgctcttcgccggcgctttgggcttagatctggctggggcgagtaggcggaggccggccgcggattcgtgacgagggaggggagccatggagctgggggcggccgggatgcggcggtcggcgtcgcacaactcgctgtccgggtccgatgacttcgacctcacacacctgctcaacaagccgcggatcaacgtcgagcgccagcgctccttcgatgaccgttcgctcagcgacgtctcctactccggtggccacgccagaggaggcggaggcttcgacggcatgtactcccccggcggcggtctacgctctctggtcggcacgccggcctcctcggcgctccactctttcgagccccaccccatagtgggcgacgcctgggaggccctccgccgctccctcgtctttttccgcggccagccgcttggtaccatcgccgctttcgaccatgcatccgaggaagtcctaaactatgatcaggtgtttgtgagagatttcgtgcccagcgccatggcgtttctgatgaatggcgagccggagattgtcaagaacttcctgctcaagaccgtgttgctgcagggttgggagaagaaggttgatcggtttaagcttggcgagggggccatgcctgcaagctttaaagtgcttcatgacgataagaagggtgttgataccctgcacgcggattttggtgagagcgcaattgggcgggttgcaccagtggattcgggcttctggtggatcatactattgcgggcctacacaaagtccaccggggatttgactctggcagagaggccggaatgccagaaggcgatgaggctcattctgagcttgtgcttgtctgagggatttgataccttcccgacattgttatgtgctgatggttgctgcatgatagatcgtaggatgggtgtgtatggctaccccattgaaattcaatcccttttcttcatggcactaaggtgtgctcttctaatgcttaaacatgacgctgaagggaaagattttgtggagcggattgcaactcgtcttcatgctttaagttatcacatgcggagttatttttggctagatttccagcagctaaatgatatttatcgttacaagacggaagaatattctcatacagctgtcaacaaatttaatgttattccagattctattccggactggctatttgatttcatgccttgcgagggtggtttttttgttggtaatgtcagtcctgcaaggatggacttccgttggtttgcacttggaaacatgattgccatagtatcatctcttgctacacctgagcaatccatggccataatggatctcattgaggagcgctgggaagagttaattggtgagatgcctctgaagatatgctatcctgctattgagaaccatgaatggcgtatcgtgacgggatgtgatccaaaaaatacgagatggagttaccacaatggaggatcttggccagtacttctctggctgctcacagcagcaagcatcaaaactggacggccgcaaattgcaagaagagcaattgacctagctgagaggaggctgttgaaggatggctggcctgagtattacgatggtaagcttggaaaatatgttggcaagcaggcaaggaaatttcagacttggtccattgccgggtatttggtcgccaagatgctgctggaggatccttcgcatcttggtatgatagccttggaagaggacaaggcaatgaagccagttttgagaaggtccgcctcatggacaaactgatatatcgacaagagctttaggggagcaacgtctggattgaaaacacgaattattcgggtagcatttctctgctcatcccttgttttgactttcccaacggaaagttttattttcttctggattcctcggctgtacaatatctcagctcatttattgagttggaaaagaagcaattgtggaaatgagtattctcttttcttttcttttcagtccatcgttgtaagaagatactattgattcttgcttggtcattccgtagtaacgggatccttgactcaaaactttgttgtttgggttgagtatatagacgagtctgctgatccagcttcctatgatgaacataagtttttatctaacgaataaagattgctccaaaaacctcggccgcgacc

SEQ ID NO: 1573 - DNA, 1054 bp, Hordeum vulgare
cggcacgaggctgggtttccccttctctcgccaccccttcttctccaccgccccttcccctcgcctcactccccacgatggcttcctccactgctctctccccggtggccttcaagtcctccttctcgccgctctccttcagaccagctcgtactaggataaatgcacaaggggcattctgtttgccatgttccacttggaaaagatctagtaatagatccttccgggtatacagtttatttggaggaaagaaagagaaagatgagaatggtgatgaggcaccagcaaagggaggaatctttggaaacattggaaatatgcaaaacctttacgaaactgtgaagaaggcccagatggttgtccaagtggaggctgtgcgggtgcaaaaggagcttgcagcgactgagattgagggttattgtgaaggtgaactaatcaaggttacactatctgggaaccaacaacctataaatgttgaaatcacggaagctgcaatggagttgggcgctgaaaaagtctccgagctggtcaatgaagcctacaaggatgcacaccagaggagcgtccaggcaatgaaggaaaggatggctgatctagcgcagagcataggaatgcctgcagggcttggcgacggtctcaagtgataaaagacctggtacttgaatgctttccaataatgaaagaagtgtctctcaattttgtattctagctgtgttgagttcatccgttaaacccctctgcgacgccggttagttgtgcacgaactgtaactgtacactcgtttccttgctcattggcacatcctagttacagcattagtgctaatgtgttttacaccaaacagatgttgctttgtgctagtgttgaggcagcctggagaacatttgtaaactaataactgcagagttaaatctgtttgtgttacgaatagagtactctttggttttggatatcgacattgtccttaaaatatgtcttacacctatgctgtaatatatcttgaaaacatacacactgttatgatgttacaaggtgctttttgaggcagggttca

SEQ ID NO: 1574 - DNA, 900 bp, Lolium multiflorum
cccttcttccccccgccatggcttcctccacagctctctctccggtggccttcaagtcttccttctcgccgctctcctccaactcaccacgtaggataaatgtacaaggtgccttctgcttgccatgttccacctggaaaagagctagtaatagatccttccgggtgtacagtttatttggaggaaagaaggagaaagacgagaacggggacgaggcaccatcaaaaggaggactctttggaaatattggaaatatgcaaaacctttacgaaactgtgaagaaggctcaaatggttgtccaagtggaggctgtgcgggtgcaaaaggagcttgcagcgaccgagattgaaggctattgtgaaggtgagctaattaaggttacactttctgggaaccagcaacctataaatgttgaaatcacggaggctgcaatggagctgggtgctgagaaagtatctgagctggtcaatgaagcctacaaggatgcacatcagaggagcgtccaggcaatgaaggaaaggatggctgatctagcacagagcataggaatgcctgcggggctcggcgatgggctcaagtgatggcttgctacttaaatgcttttcaacaatgaagcgtctctcagttttgtattctagccatattgagtcatcagttaaacctctctgcaacatcggttagttttgcaagaactgtacttgtaaacacctgtttccttgctcattggcacatcatagttacaccagtagtgctaatgtgttgtttaaagcagcgaatgttacttctgtgctagtagactggcaccccggagaacatttgtaaactaataactgcagagtgaaatctattttacaaattatgaaaaattcgtcctgagttcctattgggctgtagtgtggt

SEQ ID NO: 1575 - DNA, 1114 bp, Zea mays
actccttatcccttctctatccgccagagggaaatacccattgatctcatctcatgccctgttgccgcgcctgctcctccttccccatccgcgcccaccgccgcccctccggcagccccgccacgagcccacccgcaagcttcccgcacggccaccgctgcctggtatcaatcaaaccagtcgtccgtcctcctttccttcaaatcaagtccatttccactccctgtctaccctctccctcgtctctggtgggcggtggcctcgcctccctttccccgtcgccctgatggctccctccgcagctctcgctccggtggccttccgctccgccttctcgactccgctcgcgtcgaaccctacccgtaatagaataaacatagaaggcactttctgtttgccgtgttccgcaaggaagagagctagttatagatctttccgagtgtacagtttatttggagggaagaaggataaagatgagaatggcgatgaagcgccatcgaaagcagggatttttggaaacatgcaaaatctctatgaaactgttaagaaggcccaaatggttgtccaagttgaggctgtccgggtgcagaaggagcttgcagcgactgagattgatggttattgtgaaggtgaactaatcaaggttacactttctggaaaccagcaacctattagagttgaaatcacagaagctgcaatggagttgggtgctgaaaaactttcggagctggtcaatgatgcatacaaggatgcgcatcaacggagcgtccaggccatgaaagagaggatgtctgacttggcacagagcttaggaatgcctgcgggccttggtgatggtctcaagtgatgctgcctgccattcgggaagcctttctaataatttttttccctcaattttgaatacgagccgtgtgggcacctctcgtagtcacgtagtaagaagtgtactcgtgaccagctgtttcgttcagcgttagctgtgattttgttttgtacaagcagatatatttgcactaaatcgtggtaacgtcgtcctatggaactcggatatcacatgtggtatgctaatctgcaagatataggggatatgcaccgaaaccaatttaaatcgtgt

SEQ ID NO: 1576 - DNA, 657 bp, Pennisetum glaucum
agaataaacatagaaggtggtttctgttcgccatgctccacaaggaagagagctagttataggcctttccgggtgtacagtttatttggagggaagaaagataaagatgacaacggcgacgaggcaccatcaaaagcaggaatttttggaaacatgcaaaatctctacgaaactgttaagaaggcccaaatggttgtacaagttgaggctgtccgggtgcagaaggagcttgcagcgactgagattgatggctattgtgaaggtgaattaatcaaggttactctttctggaaaccaacaacctattagagttgaaatcacagaagctgcaatggagtttggtgctgaaaaactttctgagctggtaaatgatgcctacaaggacgcacattcaaggagtgtccaggccatgaaagaaaggatggctgacttggcacagagcttagggatgcccgcaggcctcggcgatggcctcaagtgacgctgtaatccgtgaaagccgaatcgcttttgaataattttctctcaattttgtatactagccgtgcgagacacaagtttaattaacccctcttcgacctctcttagctgtgcagagttgtacttgtgagcactgtttggttcggaattggctataattatactgtgtaccttgact

SEQ ID NO: 1577 - DNA, 940 bp, Oryza sativa
ctaccttttctcttcaacgatatcctctatcccaaaaatcgagccttttcctccccccttcctcctccaccgccgcccatctcgccgccgccgccgccgccgatggctccctccaccgccctctctccggtggccttcaagtcctccttctcgccgctcctcttcaacccgacccgttctaagataaatgtcgaaggtgcattctgtttgccatgttacaataggaaaaaggctagcaatagatcctttcgcgtgtacagtttatttgggggaaaaaaggacaaagacgagaatggtgaagaagcaccatcaaaggcaggaattttcggaaatatgcaaaatctttatgaaactgtgaagaaggcccagatggttgtccaagttgaggctgtccgggtgcaaaaggagcttgcagcgactgagatcgatggttactgtgaaggggaactaatcaaggtaacactttctgggaaccagcagcctgtaagagttgaaatcaccgaagctgcaatggaagtgggtgctgaaaaactttctgagctggtgaacgacgcctacaaggatgcacatcagaggagtgtccaggcaatgaaggagaggatggctgatctggcacagagcttaggaatgccagcaggccttggtgatggactcaagtgatagtgtggtacatgaatgcttttcaataaaaaaaaaagtgtatctcaattttgtatactagctgtattgagtcatcagtttaaaattcgtggcgagtactgttagctgtgtaagaactgtaatcgagaacatctgatcctgttttccttaatcattggcacaccataatgcattgacgcaagtgtgctgttttacaactgctgttgatgtgcagaatgaaatctgttccaaacagagaaatgggtggatgtggggaggctaattcatggggcacttggca

SEQ ID NO: 1578 - DNA, 1475 bp, Sorghum bicolor
cagtcgctcccgtcactccttatcccttcctccctgtccgccaaagaaaatccccccatcgcgtgcgctgcgcctccttccccatccgcacgcacccgcccgccgctgctcctccggcagcgtcgccaccgccacgcgcccacccgcaacccgcccgaacggccggccagcgctgtctggtattagtggtactagtatctatcaaatcagccatctgccctctgccctcctatccaaaatcaagtccatttccatttccctttcctctctaccctcactctcgtctccggcgggcggtggtctcactcacctccctttccccgtcgccccctgatggctccctcggcagctctcgctccggcggccttccgctccgccttctcgacgccgctcgcgtccaaccctacccgtaatagaataaacatagaaggtgctttctgtttgccttgttccacaaggaagagagctagttatagaccttttcgagtgtacagtttatttggagggaagaaggataaagatgagaacggtgatgagccatcgaaagcaggaatttttggaaatatgcaaaatctatatgaaactgttaagaaggcccaaatggttgtccaagttgaggctgtccgggtgcagaaggagcttgcagcgactgagattgatggctattgtgaaggtgaactaatcaaggttacactttctggaaaccagcaacctattagagttgaaatcacggaagctgcaatggagttgggtgctgaaaaactttccgagttggtcaacgatgcttacaaggatgcacatcaacggagcgtccaggccatgaaagagaggatggctgacttggcacagagcttaggaatgcctgcaggcctcggcgatggtctcaagtgatgccgcaattcgggaaacctttccaataatttttttcctcaattttgtatactagccgtgtgagtcgtaagtttaacccctctgcgacctctcatagctgcgtaagaagtgtactcgtgagcacctgttgctttcagctttagctgtaatttgctgttttgcacaagcagatatttgctccctggtaaatgaatcatggtaattaggcttgcacctggacgtcccacgcaacatgggtacatcacttgtggtctgctaggctatgttgagcatgtctccaacaagttgttgggctggagcagttgcagcctgtgaagatgagacagccaaagcccattctacatacataccaccgaaagccttcagaattggtcgtgtgaccaaaggaggaatcatgacattggtgagcgtgatttgaagagtaaaatgctaaagtttcgtttgtcacatgacatcattactagaccctagccgttgaatgtggcatgaagcagatcatggctggcatgtttgcttatgaactcactgcaaagacttcctatggcctttgtataattttcgctgcaggtgataccttccttttt

SEQ ID NO: 1579 - DNA, 1012 bp, Saccharum officinarum
  misc_feature (152)..(152): n is a, c, g, or t
  misc_feature (156)..(156): n is a, c, g, or t
  misc_feature (158)..(158): n is a, c, g, or t
  misc_feature (165)..(165): n is a, c, g, or t
  misc_feature (167)..(167): n is a, c, g, or t
  misc_feature (176)..(176): n is a, c, g, or t
  misc_feature (180)..(180): n is a, c, g, or t
  misc_feature (187)..(187): n is a, c, g, or t
  misc_feature (198)..(198): n is a, c, g, or t
  misc_feature (268)..(268): n is a, c, g, or t
  misc_feature (283)..(283): n is a, c, g, or t
  misc_feature (312)..(312): n is a, c, g, or t
  misc_feature (998)..(998): n is a, c, g, or t
  misc_feature (1002)..(1002): n is a, c, g, or t
cgcccgccgctgctcctccggcagctccgccacgcgcccacccgcaacctgcccgcacggccgagcagcgctgcctggtatagtggtactagtatctatcaaatcagccatctgccctccccttcctattcaaatcaagtccattccccttncctntncaccctntncctcgtctncggngggcggnggtctcacctncctttccccgtcgccccctgatggctccctcggcagctctcgctccggcggccttccgctccgccttctngacgccgccggcgtnaaaccctacccgtaataaaataaacatanaaggtgctttctgtttgccgtgttccacaaggaagagagctagttatagacctttccgagtgtacagtttatttggagggaagaaggataaagatgagaacagtgatgaggcgccatcgaaagcaggaatttttggaaatatgcaaaatctatatgaaactgttaagaaggcccaaatggttgtccaagttgaggctgtccgggtgcagaaggagcttgcagcgactgagattgatggttattgtgaaggtgaactaatcaaggttacactttctggaaaccagcaacctattagagttgaaatcacggaagctgcaatggagttgggtgctgaaaaactttccgagttggtcaatgacgcttacaaggatgcacatcaacggagtgttcaggccatgaaagagaggatggctgacttggcacagagcttaggaatgcctgcgggccttggcgatggtctcaagtgatgcccccattcgtgaaacctttccaataattttttcctcaattttgtatatctagccgtgtgagtcgtaagtttaacccctctgcgacctttcatagctgcgtaagaagtgtacttgtgaccacctgtttcttccagctttagctgtaatttgctgttttccgcaagcagatatctgcaccctggtatatttctagaggaaatgaatcatggtaattangctngcactttgtc

SEQ ID NO: 1580 - DNA, 809 bp, Panicum virgatum
cccttcctccctctccctcgtctccggccggcggtggcctcacctcccttgcgcccccgtcgccccgatggctccgtccgcagctctcgcgccggtggccttccggtccgccttctcgccgccgctctcgtcgaaccctactcgtaatagaataaacatagaaggtgctttatgtttgccatgttccacaaggaagagagctagttataggtcttttcgggtgtacagtttatttggagggaagaaggataaagatgagaacagtgatgaggcaccatcaaaagcaggaattttcggaaatatgcaaaatctctacgaaactgttaagaaggctcaaatggttgtccaagtcgaggctgtccgggtgcagaaggagcttgcagcgactgagattgatggctattgtgaaggtgaactaatcaaggttacactttcgggaaaccaacaacctattagagttgaaatcacggaagctgcaatggagttgggtgctgaaaaactttccgagttggttaatgatgcctacaaggatgcacatcaaaggagtgtccaggccatgaaagagaggatggctgacttggcacagagcttaggaatgcctgcgggcctcggcgatggcctcaagtgatgccgcaattcgtgaaagctgctttcgaataatttctctctcagttttgtatactagccttgtgagtcgtaagtttaacccctctgcgacttatagctatgcaagaattgtacttgtgagcactgtttcgttcagcgttagctacaatttgctgttttacacgaacagatactgtgcgtcc

SEQ ID NO: 1581 - DNA, 927 bp, Panicum virgatum
ggatggacgtcctccaacaatatcttctatcctaaaatcaagcctgtttcctcttctcgccccttcctccctctccctcgtctcctgccggcggtggcctcacctcccttgcggccccgtctctccgatggctccgtccgcagctctcgcgccggtggccttccggtccgccttctcgccgccgctctcgtcgaaccctactcgtaatagagtaaacatagaaggtgctttatgtttgccatgctccacaaggaagagagctagttataggtctttccgggtgtacagtttatttggagggaagaaggataaagatgagaacggtgatgaggcaccatcaaaagcaggaatttttggaaatatgcaaaatctctatgaaactgttaagaaggctcaaatggttgtccaagtcgaggctgtccgggtgcagaaggagcttgcagcgactgagattgatggctattgtgaaggtgaactaatcaaggttacactttctggaaaccaacaacctattagagttgaaatcacagaagctgcaatggagttgggtgctgaaaaactttccgagttggttaatgatgcctacaaggatgcacatcaaaggagtgtgcaggccatgaaagagaggatggctgacttggcacagagtttaggaatgcctgcgggcctcggcgatggcctcaagtgatgccgcaattcttgaaagctgctttccaataattttttctcagttttgtatactagccttgtgagtcgtaagtttaaccccctctgcaacttctcttagctgtgcaagaattgtacttgtgagcactgtttctgttcagcgttagctataatttgctgttttacacgaccagatactgtgcgtcctgttaactttttttttgaggaaatgcatgctggtatttggcccccctgaacaat

SEQ ID NO: 1582 - DNA, 1153 bp, Triticum aestivum
  misc_feature (82)..(82): n is a, c, g, or t
  misc_feature (85)..(85): n is a, c, g, or t
tttgtagaaccacagggttcccggattgggggccggaggcacccgaatttggcttgaaggagttaaaaatttttcccccgtngtnaacaatatcttctatcccgaaaatcaagctggttttccccttctctcgccaccccttcttctccaccgtccctcccctggagcgagcgagccctcgtctcactccccgcgatggcttcctccactgctctctccccggtggccttcaagtcctccttctcgccgctcccctccagaccagctcgtactaggataaatgtacaaggcgcattctgtttgccatgttccacttggaaaagagctaataatagatcgttccgggtatacagtttatttggaggaaagaaggagaaagatgagaatggtgacgaggcaccatcaaagggaggaatctttggaaacattggaaatatgcaaaacctttatgaaactgtgaagaaggcccaaatggttgtccaagtggaggctgtgcgggtgcaaaaggagcttgcagcgactgagattgagggttattgtgaaggcgaactaatcaaggttacactatctgggaaccaacaacctataaatgttgaaatcacggaagctgcaatggagttgggtgctgaaaaagtctccgagctggtcaatgaagcctacaaggatgcacaccagaggagcgtccaggcaatgaaggaaaggatggctgatctagcgcagagcataggaatgcctgcagggctcggcgacggtctcaagtgataaaaggcctggtacttgaatgctttccaataatgaaagaagcgtctctcaattttgtattctagctgtgtcgggtcatggttaaacccctccgcagcatcggttagctgtgcatgaactgtaactgtggacacctgtttccttgctcatttgcacatcatagttacagcattagttctaatgtgttgttttacaccaaacagatgttgcttttgtgctagtagaccggcagcctggagaacatttgtaaactaataactgcagagtgaaatatgtttacgttgcgaatagagtactctttggttatggatatcgacattgtccctaaaacacggcttaaatctatggtgtaatatatcttaaaaaatatattttgttataatgtgcaaag

SEQ ID NO: 1583 - DNA, 1055 bp, Triticum aestivum
atttcctcttccagtgctctctactgtttttccccgtcgtcaacaattatctcctatcccgaaaatcaagctggttttccccttctctcgcttccccttcttctccaccgtccctacccctggagcgagccctcgtctcactccccgcgatggcttcctccactgctctctccccggtggccttcaagtcctccttctccacgctcccctccagaccagctcgtactaggataaatgtacaaggcgcattctgtttgccatgttctacttggaaaagagctagtaatagatccttccgcgtatacagtttatttggaggaaagaaggacaaagatgagaatggtgatgaggcaccgtcaaagggaggactctttggaaacattggaaacatgcaaaacctttatgaaactgtgaagaaggcccaaatggttgtccaagtggaggctgtgcgggtccaaaaggagcttgcagcgactgagattgagggttattgtgaaggtgaactaatcaaggttacactatctgggaaccaacaacctataaatgttgaaatcacggaagctgcaatggagttgggcgctgaaaaagtctccgagctggtcaatgaagcctacaaggatgcacaccagaggagcgtccaggcaatgaaggaaaggatggctgatctagcgcagagcataggaatgcctgcagggctcggcgacggtctcaagtgataaaaggcctggtacttgaatgctttccaataatgaaagaagcgtctctcaattttgtattctagctgtgtcgagtcatggttaaacccctctgcagcatcggttagctgtgcatgaactgtaactgtggacacctgtttccttgctcatttgcacatcatagttacagcattagttctaatgtgttgttttacaccaagcagatgttgctgttgtgctagtagaccggcagcctggagaacatttgtaagctaataactgcagagtgaaatctgtttacgttgcgaatagagtactctttggttttggatatcgacattgtccttaaaacacggctta

SEQ ID NO: 1584 - DNA, 2119 bp, Zea mays
gcttcgttataacataaatgtattatataactatatctctcatataatttaagataatatacaaatatattacatatataaatatataaacttaattagttttgtctaaattataattattaaaataaaattcaattccaacgaaatcaacagggtcttagaattccctaggattgagtggaaaatcctcgtaatcccgaaataaatttttaatcttttccaaactagcccttaccagataattctttcccgtacgcacccacccaatcccggaaatatattcataccgacagcacagctcgccaacactccgatacgcggggatgcatagacgtcggcaggaggagctcatgtcgaacaccaatagcgttagccaccaccagtagccacagcagtcatggggtcggtgccgccggcagagggggacaggcgccagccccagcagcagccacacgtggtgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgcgccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacggttacctggacaccgtcgtcgactggatcccttgcgcgcccaaggacctgcagctccgggacttcccgagctttgtgcgcaccacggacccggacgacatcatgctcaacttcttcatccacgaggtagaggcgatgtcgcaggcgtcggcggtggtcatcaacaccttcgatgatctcgacgcgacgctgcttcacgccatggcgaagctcctgtcccggcccatctacaccgtgggcccgctcctgctgacggtgcgaaacaacgtccccgcggacagccccgtcgcggccatcgggtccaacctatggaaggaacaagaggcgccgctccggtggctcgacggccgcgcgccgcgctcggtcgtgtacatcaacttcgggagcgtcacggtgatgtccaacgagcagctggtcgagttcgcgtgggggctggccaacaccggctacaccttcctctggaacgtgcgcccggacctcgtcaagggcggcgactccgccggcgcggggctgccaccggagtttctggccgcgacggagggccggagcatgctgtcgacgtggtgcccgcaggcagaggtgctggagcacgaggccgtggggttgttcttgacgcactccgggtggaactccacgattgagagcatctgtggcggcgtgcccatggtgtgctggcccttcttcgctgagcagcagaccaactgccggtacaagcgcaccgagtggggcatcgggatggagatcggtaatgacgtccggcggggcgaggtgaaggcgctcatacgggaggccatggagggggagaaagggcgggacatgcgccgccgcgtcacggagcttaaggggagcgccgtggccgcggcgaagctcaacggacgctctatgcgcaacgtggacaggttcatcgatgaggtgctcctagcttgagcattaaggtttttttacaatggtggccttagttttgcctctgtactcaagtctactcttatttttgcttcttcctcggttttacccaccatccagccgtccactgccttggcttagatcaaggctcgcacgccgtgtcccccactgttatgttatgaaaacaaaaacggtaattttcagataccggaaatcgttttcgaaattttatcaagatttaggtctaaaaaaaaa

SEQ ID NO: 1585 - DNA, 2390 bp, Zea mays
atccttaatcctcctgcagataaacaccctatcaacgcaaatccccagctcttccaacctctcctctccctccccatcagcgcacagatctatcgatcactacggttccatctcgcacccaactaggcctccgattattccgatcgccagcggatcagatttatgcagtcttactgccgccagctccagccatgccgcggggcagcagcttggaccagagcctgagcgacgaggagcggtcggcaggtactggggcggtttgggtccggcgtcgccggcaatgtccgggatgtccgactccgcgggcggcgggcgtgcgggcgcagagctgatggtggagcagttccacctcaaggtgctccacgccgtcctcgccgtgcgcacgccgcgcccgctcgccgccgccgccgctgccgcgtcgtcgtcgtcgtcgttcaggcggagggacaggtggttccatctcccgctccacgacccgccgccgcccgaggcggccggtcgcctcgacgagctggcccccgggcagccgcgtgtggtggacgtcctcctgtgtcctgccaccgccagtggtgtgggagaccgaggggaggtggtggagaggtggaccgtggcgtgcgagccctggccagacgccgcgagcggcgaggaggttgccgtgaaccgggcgtacaagcactgcttcacgctgctcaggtccgtttacgccgcgctccgcgtcctcccggcctaccgcgtcttccgcctcctctgcgccaacgcctcctacaactatgagatgggacaccacgttgacaccttcgccgagcccttctcgcgccctcaggaggccgccatgcgttcccaacgcttcgttcccgtcgaaacccagctcggtcgcctcgtcgtttccgtccactatctccccagcctcgccggcgtcgccgccttcaacctcgagatcacccccctttcgccctccatgataatcccagactacgtcggcagcccagccgctgagcccatgcgcaccttcccggcctcgcttacagaagccacgggctccggcttcccaccgtcctatgagcagcagcgtccacacagctgggcttcacctgcgttctggccgcacacgccggcacaccaggccaggttctcgccacctccagtgttttatgcgtcaccgacgccatcgcctccccactttccgcccggtctcatgaggtgggagtctgcgccaatgcccataccacaggtgagcgagaggaggagccccgcacacctccagaatatgctgccaccgccttcgccgagaagagcagacacgggggcagcaggtgctctagagtttccatctgagagtggccggttgattgggaggatggaggaacttcggctagctgatctacatgcgacctcgtcacccagacacaagggcaaggacaataaagatgaatctggcagattctctgcactctcctcatgtgattcaccacggcaagatgatctggatgatgtggattaccattttgatgttgatgatgttgataccccagtctctcaacctcggagcactagcgggaaggaaacaggtgatcaggttggttcattgccccacaaatctcaagacgcacaggtcggttatctagtcaacctgctgagaaacgcccgcccgctgcgaaatcctagcaatccatcacaaacaccaagggctcagtccaccagagtaacctcagcaagctcggtcaccacatctgacgcgctggaggtgctccagtccttcaaagagacaagggagcgactgctgtcccggagcagcgcaaaacatcaagagccaccgggaaagccataggcccattctttgctttgtttctcttaacgtgatcgctggtagacccccaaccaaccgcgaaacgggatgcacaatgagctaagcggactatagctgctgtgttcatgtacatatgactgccgaagttgatgcctttggttggagagaaggcaccggtttccatttattccagcggaaggatcactcgtcgtttttaagagtgatgccgctgttgataccccctttttttgtatatgggaagtgaaaccgatacacgtaggtgggagcgagggagcctgtgaactgtgatagatgaaagcagggcgtgtgtgtgtgctgtgtgtgtaaattatgtaactgctgggaatcaaatgtttcattggacatcaagctttgatctgggaagttgtggattggcgaactgcaggctgtagttggaaaaggaactctcggttgaattgagagttccaaattataattgaaacatagtatatgtacatcatgtattttgttttgttgttgttttaaacgatctgttgtgcaatacggattagagtctctcgccggttcgattgttgctgct

SEQ ID NO: 1586 - DNA, 2344 bp, Sorghum bicolor
gcgatccttaatcctccctgcagataaacaccccctctccctctgcatctccacacccaaatccccaactctttcaacctcccctctccctccccatcagcgcacagatctatcgatcgctacgatcccacgcacccaactaggcctccgattccgatcgccagcggatcggatttatgcagtcttactgccgcgagcgccagccatgccgcgcggcagcagcttggaccagagcttgagcgacgacgaggaggggtcggcaggtgctggggcggtttgcgttcggcgtcgccggcaatgtccgggatgtccgactccggtgggggcgtgcgcgcgggcgcggagctgatggtggagcagttccacctcaaggtgctccacgccgtcctcgccgtgcgcacgccgcgcccgctcgccgccgccgcggcgtcgttcaggcggagggacaggtggttccatctcccgctccatgacccgccgccgccgcccgaggcggccgaccgcctggacgagctggcccccggggagccgctggtggtggacgtcctcctgtgccccgccggtggtgtgggagcccgaggggaggtggtggagaggtggactgtggcgtgcgagccctggccggacgccgcgggcggcgaggaggttgccgtgaaccgggcgtacaagcactgcttcacgctgctcaggtccgtctacgccgccctccgcgtcctcccggcgtaccgcatcttccgcctcctctgcgccaacccctcctacaactacgagatgggccatcgcgttgacaccttcgctgagcccttctcgcgcccccaggaggccgccatgcgttcccaacgctttgttcccgtcgaaacccagctcggtcgcctcgtcgtttccgtccagtacctccccagccttgccgccttcaacctcgagatcacctccctttcgccctccgtgataatcccagactacatcggcagcccagccgctgagcccatgcgagccttcccggcctcccttacagaagccacgggctccggcttcccgccgtcctatcagcagcagcgcccacacagctgggcttcgcctgctttctggccgcacacgccggcacaccaggccaggttctcgccgcctccagtgttttacgcgtcaccgacgccgtcgcctccccactttccaccccgtctcatgaggtgggagtctgcaccaatgcccataccacaggtgagcgagaggaggagccccgcacaccgccagaatatgctgccacctccttcgccgagaaggggagacatgggggcagcaggtgctctagagtctccatctgagagtggccggttgattgggaggatggaggaacttcggatagctgatccatatgcaacctcgtcacccagacataagggcaaggacaataaagatgaatctggcagattctctgcactctcctcatgtgattcaccacggcaagatgatctggatgatgtggattaccattttgacgttgatgatgttgacactccagtctcccagcctcggagcgctgatgggaaggaaacaggtgatcaggttggttcatcatcccataaatctcaagacgcacaagtcggttctctagtcaacctgctgagaaacgcctgtccgctgcgaaatcctagcaattcatcacaaacatcaagggctgagtctagcgaagtagcctcagcaagctcagttacgtcccgcaggacatctgatgcgcttgaggagctccagtccttcaaagagataagggagcaactgctggcccggagcagctcaaaacatcaagagccaccgggaaagccatagggccattctttgctttgtttctcttaacgtgatcgctgatagaccgacccccaactgcaaaacgggatgcacaatgagctaagcgaactatagtcgctgtggttgtatatatgactgctgaagttgatgcatttggttgaagagaaggcaccagtttccatttatttcagcggaagaatcactcgtcgttcttaagagtgatgccgttgttgttactcttttgtgtatatgggcagtgaaaccgatacacgtaggtgggagcgagggagcctgtgatggatgaaagcagggctcagtgtgtgtgcgtgtgtgtaaattatgtaactgctggaaatcaaatgttcattagacatcaacctttgaagaattgctcgcacttaacaatactagttttatttgctcttgctattggatctgggaagttgtggattggcgaactgcagactgcaatttgaaaaagaactctcagttctaagttataagacgttttgttttttctaaatatattgctatatatagt

SEQ ID NO: 1587 - DNA, 2146 bp, Panicum virgatum
cccaactcctccaatctctcctctcatctcctgtcagcggcgcacggatccttcgatcggtccgatccaggcacccgcccaggccgatcgcaagcggatcggatttatgcagtcttactgccgcgagcgccagccatgccgcgcggcagcagcttgcgccagagcttgaacgaggcggaggaggggccgggcggcgctcgagcggttcgggttcggcgtcgccggcaatgtccgggatgtccgactccgcggggggcggacgcgccggcgcggagctgatggtcgagcagttccacctcaaggtgctccacgccgtcctcgccgtgcgcacgccgcgcccgctcgccgccgccgccgcggcgccggcggcggcttcggcgttccggcggagggacaggtggttccacctcccgctgcacgacccgccgccgccgcccgaggcggccgaccgcctggagccgctggcccccggggagccgctcgtggtggacgtcctgctgtcccccgccggcggtggagcgggaccgggaggggaggtggtggagaggtggacggtggcgtgcgagccctggccggacgccgcgggcggcgaggaggtggccgtgaaccgggcctacaagcactgcttcacgctgctcaggtcggtgtacgccgtgctccgcgtcctcccggcgtaccgcgtcttccgcctcctctgcgccaaccactcctacaactacgagatggtccaccgcgtcgacaccttcgccgagcccttctcacgcgcccaggaggccgccatgcgctcccaccgcttcgtccccgtcgagacccagctcggccgcctcgtcgtctccgtccagtacctccccagccttacctccttcaacctcgagatcacttccctttccccctccaacataatccccgactacgtcggcagcccagccgccgagcccatgcgcgccttcccagcctcgcttaccgaagccaccggctccgccttcccatcgtcctatcagctgcagcgcccgcacagctgggctccgcctgtcttctggccgcacacgccggcacaacaggtgttttacgcctcacccacgccctcgccgccccactttccaggtgggtacctgcagaagcgtctcactaggggggaatcagcgccaatgccaataccacaggtgggtgagaggaggagccctgtgcaccgccagaacacgctgccaccgccatctccgagaaaaggagacatgggggcagcaggtgctcaagagtctccgtcagagatcggccggttgatagggaggttgtcacccagacataagggcaaggacaacaaagatgaatctggcaggttctctgcactctcctcatgtgattcccctcggcaagacgatctggatgattatccttttttcgtggatgatgttgatcccccagtctccaaacctggaagcagtgatgggaaggaaacaagcgatcaggcatgttcgttgtcccataaatctcaagatgcacaagttggttctctagtcaacctgctgagaaacgcgtgtccgctgcgagatcctagctattcattacaaacatcaagggctgagcccagcgaagcagcctcagcaagctccgccacgtcccgtaggacatctgatgcacttgaggagctccagtccttcaaagagataagggagcgactgcagtccaggagcagtgcaaaacatcaagaaccaccagggaaaccatagccaccattctttcccttgtttctcttaacatcacctctgataagagaccccaaacggccaaatcacaacacaggatgcccggtgagctgagccaacgtattctgttgaggtgctcatgtatatatgactgctgaaattgatgcttttggttgaagagaaggaaccagcttcaatctatttcagcgacagaatcacccactcatcgttcttaaagggtgagggccatgatctgccgctgtactcttttgtgtatatgggaggtgaagctgatacgcgtaggtgggagggagcctgttatggatgaattgctctagtgtgtgcgtttgcgtgtgtaaattatgtaaccgctcagaaccaagtgttcagtagacaccaatctttgaagaattgctcgcgctcttcagatgactagttttctt

SEQ ID NO: 1588 - DNA, 1217 bp, Zea mays
agtcacggacacatggtgtgtttggttggatctcgtcccggtctttcacctccaacaaaacacatcctaatcgactcgcgaccccgtttcccggagagccgcgacggtgcgacgccgaactccctaaccctaagtccctaagcgtaggcggcggggggcggcggtgcgaggcaagctgcacagcaacacgggccacgggcgcggcctccgcctccgcctccacgcttctgctgctaggctgcaagggcggcggcgcggcgcggtgggcggcggacagctggccaggtccagcccagtagtccaggtgacgaggtccgcactccgcaacggttctggcgttctgcagctgaggatagacgagagaggaagtgaggatttatattagtgatttacaaggcaacttgaaagacagcagggttgcatcccacaatgtcagctcccaacagtgatagcaacatgcagcagctagtccctatagcaccaccaggaaaggcttctggtggtgacagtgggaaggagctggttgtggcagatcctgcaggtaagagatcaggaggtgtaaaactgcgagaggatgaggaagacctggaggtgaagctcaggcgcatcatggagaatgtccctgtgcgtgtcagtaacacatcagggtcatctgctggctctggctctggtgatttccaccagtatcggcaaatgaggaggagagagcaggaccgtctagcacgaatggatgcggactaccagaagagaaaagagatagctgagttcgaactgcggagggaggagaggatgaaagcagctgaggagcggacagccaagaagcgcctgaaacggcaaaagaagaaacagcgtaagaaagagaagcgagctaaaactggtgataatggtggtgaagaacctaacagagtggagtcgtctgacgatgacgaaggctcagatgacgatgacaagtccaagcaatgacacgtcaatttcgcacctgaagatgatttcggactctctggttgtctgggcaatgaaacaaacgtctgtacggttgttgtaacaggttacagggcgaatctggtgctgtttctgtaagaggatatgatattctgagcagagatggatagcactagataatttgctgttagtgttcatcattcagagaagtgacctgcgtcagtaccttttgttcaggtctatattatatcagctgccttttttggctccatttt

SEQ ID NO: 1589 - DNA, 1034 bp, Oryza sativa
ctaatcgaatcgatcgacacacgaaacacaagttcgaggagagaaaaccaaaccctagctaggctaaggcggagtggagaacccccgccgttgccggcggcggaggcagcggcggcggcgcgcggagaacactccgtcgcggtcgattccgtatcaacaatgtcagatcctggaagggatagcaacatgcagcagctcatcccgatagcacctccaccaaaggcttcttctggtaccactggcaaggagctcgtggtcgtggatggtacgggaaaggcttcaggaggagtcaagctacgggaagacgaggaggacctggaggtgaagctcaggcgcatcatggagaacgtccctgtccgtgtcagcaacacctccggatcctctgctggttctggctctggtgatttccaccagtatcggcaaatgaggaggagagaacaggaccgtcttgcaaggatggatgctgattaccagaagaggaaacagatggctgagtttgaattgaggagggaggaaaggctaaaagaagcagaggagcggacagcaaagaagcgcctgaaacgccaaaagaagaagcagcggaagaaagagaagaaacgatctaaaactaataatggtggcgagcaacctaacggaggggagtcgtctggtggtgatgaggattcagacgatgaagataagccataggcaagtggcacacatcaatcggatttgaagttgctattagactactgttgaaccatttcttggagattacttctgaagtagagctttgagcatgaactaatattggcaggctgcaggcccccttgtagttttttcttggaaacactcttaagatgagatgtggcttgttttccttgctctgataaagtgactatggagtatggatggatagatgaatcattttctggttaccttgtttgtttcttctgaattatcatgtctggggctccctgtcccttacaatagcttactcgtgacatttaaatgaatgaaatttaactgtttagcaatttgagagctggctaaca

SEQ ID NO: 1590 - DNA, 1290 bp, Sorghum bicolor
acctctcgagtctgactccgcaccccgtccgcgtccgacgtccggcgctcgtcctcccggctctccctccctgcccgccgcggcgccgccccttctcctccttggcttctcttgatcttctccccaagcggccaagccacctcctgccggctgccctcctccgtgtccctgccggcggccacggccagcagcactcagcaggcgctccgcgccccgcgcccaggccggcagaccgcccccgcgagccgcggtcccgcccggccgccctcctcgcagtctctcgtccacgtctagtaggcagcaccgcggcaggcagccaggcctgagacgcccaggctcctgctcccgactcgccggctgcactccccctgctcctggctcctgcagtcctgcatctgtcatctgtgctgcttctgcacatctcggcaacttgagagacaagcagggttgcatcccggcatcccgcaatgtcagctcccaacagtgatagcaacatgcagcagctagtccctatagcaccaccaggaaaggcttctggtgctgacagtgggaaggagctggttgtggcggatcctggaggtaagagttcaggaggtgtaaaactgcgagaggacgaggaggacctggaggtgaagctcaggcgcatcatggagaatgtccctgtgcgtgtcagtaacacatcagggtcctctgctggctctggctctggtgatttccaccagtatcggcaaatgcggaggagagagcaggaccggctagctcgaatggatgctgactaccagaagagaaaagagatggctgagtttgaactgcggagggaggagaggatcaaagctgctgaggagcggacagccaagaagcgcctgaaacggcaaaagaagaagcagcgtaagaaagagaagcgagctaaaactggtaataatggtggtgaagatcctaacagagtggattcgtctgatgatgatgaaggttcagatgacgatgacaagtccaagcaatgacacgccaatttgcatctgaagatgatttctcactctggttgtctgggcaatgaactaacgcctgtatggcagttgtaacaggctgaatctggtgctgtatctgtaagaagttgtcattttgagcagagatggagagcactagataattttctgttagtgttcatcatttagagaattgccctgcgtcattaccttttgttcagctctatatattcttctctcagctgtcttttttggggtccatgttaccatgggctcgagacaaaattaagcatctaagagcatctct

SEQ ID NO: 1591 - DNA, 887 bp, Sorghum bicolor
gaccgccccgccggcgccggcccccgaccgccccttctgctgtcgggagctcttctgcagccggcaggcagcaccccgccccattttgatttgattttccagggagaaaggcgagtccttttgcgcctaagcttggacgccagtcttgagttcgttaaggtcgacctcacaccagcgaggccaaggcgtactgcatacatcacacctcagaaatcagacctcaaaggcaacttggaagacaagcagggttgcaccctgcaatgtcagccctcaacagtgatagcaacatgcagcagctagtccctatagcaccaccaggagaggcttcttgtggtggtgacagtgggaaggagctggttgtggtggatcctgcaggaaagagttcaggaggtgtaaaactgcgagaggatgaggaggaactagaggtgaagctcaggcgcatcatggaaaatgcccctgtgcgtgtcagtaacacatcaggctcctctgctggctctggctctggtgatttccaccagtaccggcaaatgaggaggcgagagcaggaccggatagcgcgaatggatgctgactaccagaagagaaaagagatggctgagtacgaactacggagggtggagaggctgaaagcagccgaggagcggacagccaagaagcgcctgaaacggcaaaagcagaagcagcgtaaaaaagagaagcgagctaaaactgataataatggtggcgaaaaacctaacagagtggagtcatctgatgaggatgaaggttcagatgacgacgatggcaagtctacacgttaatttcatttgaagacaaatttgtctagtatattgcctgtgctaatgctacagtgacattgtttttatatatttttatgaaattatttt

SEQ ID NO: 1592 - DNA, 1290 bp, Panicum virgatum
gaggattcctgccacgggcggcggcggcgacgacgtagggagcgtcggagcgaggagccccttgggcgggggccactggggcgtctggaagaggagttaaggaggatccagctggggcaccgcgtgcccggtctctgggctccagctcgaggcagcttgaaaggcaacttgagttgtatcctgcaatggcaactcccaacagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacttggaggtgaagcttaggcgcatcatggagaatgtccctgttcgtgtcagtaacacatcagggtcatctgctggatctggctctggtgatttccaccagtatcggcaaatgagaaggagagagcaggatcggcttgcacgaatggatgctgactaccaaaagaggaaagagttagctgagtttgaactgcggagggaggagaggcttaaggcagccgaggagcggacggccaaaaagcgcctgaaacgccaaaagaagaagcagcggaagaaagagaagcgaactaaaaccggtaatggtggtgaagaacctaacagagtggaatcatctgatgacgatgaaggttcagatgatgatggcgagtccaagcaatgacacggcagttgcatttgaagatgctttttagactgtcatcataaatttgatggagggctacttgcttcttgaagaaggaagcctgtgtgttcctccctggttaatcgtgggcaatgaactaacatctggtttgcctgctgtaataggctgagtcaagaggatctttatagcattcagactgagatggagagcactgcctgttagtattcctcattcggggaactgccttgcattagtaccttttgatcagctattattagtcggagatggaaagcactagatagtttcttgcctgttgtaataggttgagtcaagagagctgagatgaagagcactgctgttagtattcctcattcggggaactgccttgcatcagtaccttttgatcacctattgacattttaatcagagatggaaagcactagatagtttccagttagtgttcctcgtccacagttgccttgcatcagttcctttcatcatccccatgtatgcttgtggcatgttgtttgtatcactgtcagttattcgtgtatttctcaaaatcttgtaaaatgtgtgttcttttttcctg

SEQ ID NO: 1593 - DNA, 1047 bp, Panicum virgatum
gaaaaggccatcgagcgcagcgggagaagaggatttcctgccacgggcagcggcggcggcggcgacgtaggggagcgtcggagcgagccccttgggcggcggccactggagcgtctggaagaggagttgaggaggatccagcagtggcaccgcgtgcccggtctctgggctccagctcgagtttgaaagacaacttgagttgtagcctgcaatggcaactcccaacagagatagcaacatgcagcagctagtccctatagcaccaccaggaaaggcttctggcagtgacactgggaaggagctggttgtggttgatcctgcaggaaagggctcaggaggagtaaaactgcgagaggatgaggaggacctggaggtgaagctcaggcgtatcatggagaatgtccctgttcgtgtcagtaacacatcagggtcatctgctggatctggctcaggtgatttccaccagtatcggcaaatgaggaggagagagcaggatcggcttgcacgaatggatgctgactaccaaaagaggaaagagatggctgagtttgaactgcggagggaggagaggcttaaagcagctgaggagcggacggccaaaaagcgcctgaaacgccaaaagaagaagcagcggaagaaagagaagcgaactaaaactggtaatggtggtgaagaacctaacagagtggagtcttctgatgacgatgaaggttcggatgatgatgatggcaagtctaagcaatgacacgccaattgcatttgaaggtgctttttagactgtcactgtagctttgacggagggctacttgcttgttgaagaaggatgcctgtgcgttcctccctggttgatcgtgggcaatgaactaacatctggtttggccgttgtaataggctgagtcaagaggatatgtataacatttagagctgagatggagagcactagaaagttttctgttagtattcctcattcggggaactgccttgcatcagtaccttttgatcagctattaacattttaatcggagatggaaagcactagagagtttc

SEQ ID NO: 1594 - DNA, 1399 bp, Hordeum vulgare
ctagactacgccacgccaccgtcccccgatgagagccgcagccacatccacagccatctccctcctctcgccctcccacctccggacctccgctgccgccagcctcccctaccgccgccgcccccgcatcgccgcgatggccgccgccgcctcctccttccgcccggaggccgcgcgctcgcccgccgccgtcgagcccccggccccgccgctctccaagttcaaggtggcgctgtgccagctctcggtaacggcggacaaggctcgcaacatcgcgcgcgcccgcgccgccatcgagtccgccgcggccgacggcgccaagctcgtgctcctcccggagatatggaatggtccatattcaaatgacagctttccagagtatgctgaggacattgaggctggtggcgatgcagctccgtcattttcaatgatgtctgatgttgctcgcagcttgcaaattactcttgttggtggatccatatcagaacgttctggtaacagcttgtacaatacatgctgcgtctttggttcagatggcaagcttaagggtaaacatagaaaggtccatcttttcgacattgatattccaggaaagattacatttcaggaatcaaaaactcttactgctgggcaagatcttactgttgttgacacagatgtgggccgaattggtataggcatttgctatgacattcgtttccaggaattggcaatgttgtatgctgcaagaggtgctcatttgctatgctatcctggtgctttcaacatgactactgggccattgcactgggaattgcttcaacgggcaagggctgctgacaaccagctttttgttgcaacctgtgctccagctcgagataccggttcaagttatgttgcttggggacattccactcttgttggaccgtttggcgaggtgatcgccacaaccgagcatgatgaagcaactataatagcagagattgactattcattgattgagcagaggcggcaattccttcctctgcgacaccaacgacgtggagatctttatcagctggtagacgtccagggatcgggttccaagtagactgtcctcattgctcgcgccggcgtgatccgtgaaagcaacagccgccgattgggaaggcaagctcaagctttcggatcgcgagatgatgagataatgtgcgagaaggggacagaaccaaataaggagatactgtatgtaacatgtataactgcctgagttgcgaaataattgaaccgcattggcaggaacaaaaatcgataaatgtcactcaacctgttggggttacttgtgctatgtttgagatgaagcaaacatggcatgattacttcatccaacctgcttctagcctcgtactggcatggcatgcatgagtggggtgagctgaag

SEQ ID NO: 1595 - DNA, 2332 bp, Zea mays
gctgatgcgcatccatccggcaactactcacgctcaggtcgccgtcgcgactcgcgccgcctctcggctcgctagccgctacgctatctacgccgccccggcacctcccatgagatgagagccgcagccgcagccacatccacagccgccgcgctcctcgcccccggtctaaagctctgcgcgggcggcgcccgcgcgcgcgtctcctgtccctcccgctcccgcctcccactccaccgcatcgccgccatggcctccgcccccaacccctccttccgcccggaggaggcacgctcccctcccgccctcgagctcccgaccccgccgctctccaagttcaaggtggcgctgtgccagctctcggtgacggcggacaagaatcgcaacatcgcgcacgcgcgcgcggccatcgagaaggcggcctccgagggcgctaagctcgtccttctcccagagatatggaatggtccgtattcaaatgacagctttccagagtacgcggaggacattgaagctggcggagatgcggccccttcattttcaatgatgtcggaggttgctcgcagcttacaagtcactcttgttggtgggtccatagctgaacgttcgggaaacaacttatacaatacatgctgcatctttggttcagatggcaaacttaagggtaaacatagaaagatccatctttttgacattgacattccaggaaagatcactttcaaggaatcgaagactcttactgctgggcagaatcctactgttgtagacacagatgttgggcgaattggtattggtatatgttatgacatccgtttccaggaattagcaatgttgtatgctgcaagaggtgctcattttttatgctatcctggtgcattcaatatgactactggaccactgcattgggagttgctgcagagggcaagggctacagacaaccagctgtttgttgcaacatgcggcccagctcgagataccagtgcaggttatgttgcttggggacactccactcttgttggaccttttggagaggtgattgcaacaactgagcatgaggaggcaactataatagcagaaattgactactcactgattgagcagaggaggcaatttcttcctctgcaacaccaacgccgtggcgatctctatcagctggttgatgtccagaggctgggttctcattagcacagggacgaagcaggagagcagttgactctgcaggcttgctcgtactacttcgttcatgagatgcatgcccatgcccatcgagagatcgatcaacttgatgtgtgaaggtggagaggacggaataaagcgactatagtttgtaccttcagcgctagtttggcaactctattttacaagagattcttatttttctaaggaaaaattgattaatttttcttaggaaaatagaaatcacttgggaaaatatgattgccagactagccctcagtgtaaatgtctccatttgtcgaataaattgattactttaacctatgaagaaaacctttctccatgaaacaaagataaacggaggatcttctccgatttccttttgggccgtaccaatttgaattttgaactagcttgtgcgcctcctggagccgatgtagcaatggatactccagtgtttggccatcagcagccacagtactagagtatgcatgggtatattttcgtatgggtatgatggcagggaagggcaaacctgtgaacaggttccctgtcgatgctgcagagggcggcagacctgcacggtgcacaactgtcagctgtttgttgcagcatgcgctccgggtcgagataccataccagtgcaggttatgttgcttggggatggggacacactactcttgttggacttatgtgattgcaacaaccgagctagcatggagaggcaactatagggaggtacgcagagtgaaacacctttggttgaacggggtggcgcaagatcttctctaggcaatttcttcctctgcaacaccaacggcgtggcgatccctaccagctgcaagatgtcccggagactggatggatcctcagcagcgagcctggatgcagctgtgagtgcctgtgacctgtgacgaagcaggagagcagttgactctgcaagcttgctcgtactaccgcgttcatcatgacatgcatgtcgatgccctgtctagagatcgatcgacctgatgtgtgaaggtggagagcaggggacgagggcgagtaaaggcgacaatagtacgtaccttcactgtgtctccggttgccaaataataaatagattacagtaggaagaacaccgctctacatgaaacaaagataaacggattatcta

SEQ ID NO: 1596 - DNA, 1316 bp, Oryza sativa
acaccccacgccgccttcctctcctcggctactcccaaatgagagccacagccgcagccgccttctcactcctcacctgctcctgtctccggagcaccagcccgaccaggctcccctcctcctcgctccgcctcccgctccgccgcggcccgctcgccgcgatggccacggccgcctccttccgcccggaggccgcgcggtcgcctcccgccgtccagcccccggcgccgccgctctccaagttcaaggtggcgctgtgccagctgtcggtcacggcggacaaggctcgcaacatcgcgcgggcgcgcgaggccatcgaggctgccgcggcgggcggcgccaagctcgtgcttctcccggagatatggaatggtccatattcaaatgacagctttccagaatatgccgaagacatcgaagccggtggtgatgcagctccttcattttcaatgatgtcagaggttgctcgcagcttgcaaattactcttgttggtggatccatatcagaacgttctggtaacaagttgtacaatacatgctgtgtctttggttcagatggcgagcttaagggcaagcacagaaagatccatctttttgacattgacattcctggaaagattacattcaaggaatcgaagactcttactgctgggcaggatcttactgttgtagacacagatgtaggccggattggtataggtatttgttatgacattcgtttccaggaattggcaatgttgtatgctgcgagaggtgctcatttgttatgctatcccggtgcatttaacatgactacagggccattgcactgggagttgctgcaaagggcaagggctgcagacaatcagctgtttgtggcaacctgtgcaccagctcgagacaccagtgcaggttatattgcttggggacattccactcttgttggaccttttggggaagtgattgctaccgctgagcatgaggagaccactataatggcagaaattgattattcattgattgatcagaggaggcaatttcttcctctgcaatatcaacgccggggcgatctctatcagttggtagatgtccagagatccggctctgatgagtagccagcctggatgcattgcgccactaggcgtgatccgtgaaaatattattcgtccgcgagatgcatgtgcccacccttatccgcagcagttcacccaggaacattgacttcgtgtgtgaagaggtgacctgtaacacgtaccttgccaaattgatttactataaacattatcatggtaataataaaaggtcgaaattaaatgctcttttctctgctgtcaaaa

SEQ ID NO: 1597 - DNA, 1730 bp, Sorghum bicolor
caaacgttgcaggcacattccactgacaaaccgggcccacgagctgctgatgcccatccatccgccaacaacttcccgttccggtcgccgtcgcgactcacgccgcctcctcgctagcggctaccctactatctacgccgccacggcacctcccccatgagatgagagccgcagccgcagccgcagccacatccacagccgccgcgctcctcgccccgggtctaaagctctgcgcgggccgcgcgcgcgtctcctcctgccgcctcccactccgccgcgtcgccgccatggcctccgcccccaactcctccttccgcccagaggaggcacgctcccctcccgccctcgagctcccgaccccgccgctctccaagttcaaagtggcgctgtgccagctctcggtaacggcggacaagagtcgcaacatcgcgcacgcgcgcgcggccatcgagaaggcggcctccgacggcgccaagctcgtgctcctccccgagatatggaatggtccgtactcaaatgacagctttccagagtatgccgaggacattgaagctggcggagatgcagccccttcattttcaatgatgtcggaggttgctcgcagcttacaaatcactcttgttggtgggtccatagctgaacgttctggcaataacttgtacaatacatgctgtgtctttggttcagatggccagcttaagggtaaacatagaaagatccatcttttcgacattgacattccaggaaagatcactttcaaggaatcaaagactcttactgctgggcagagtcctactgttgtagacacagatgttgggcgaattggtattggtatatgctatgacatacgtttccaggaattagcaatgttgtatgctgcaagaggtgctcacttgttatgctatcctggtgcattcaacatgactactggaccactgcattgggagttgctgcaaagggcgagggctgcagacaaccagctgtttgttgcaacgtgcggtccagctcgagataccagtgcaggttatgttgcttggggacactccacgcttgttggaccttttggagaggtgattgcaacaactgaacatgaggagacgactataatagcagatattgactattcactgattgagcagaggaggcaatttcttcctctgcaacaccaacgtcgtggcgatctctatcagctggtagatgtccagagactgggttctaattagcaagcctggatgtggctgcgaggctgtgacgaagcaggagagcagttgactgtgcaggcttgctcgtactacttcgttcatgagctgcatgtccatgccctgtctactgtctagagatcgatcaacctgatgtgtgaaggtggagccgacggaataaggcgactatagtttgtaccttcagtgtatgtgcctcaagttgccaaataaattgattacttgaacgtatgaagaaaacctctctccatgaaacaaagataaacggaggatttgctccgatttccctttgggtcctgccagtttgaagtttgaactagcttgtgcgcgacctgagctgatgttgcaatggatcctcgcatttgtttggccatcagcacttcagcagccacagtactagagtaaatgggtatgattgtagggaagggcaaacctgtgaactattcccgccgttctaaattgtatatcttcgcgccattgctgaatcgatatctatcgtttcggagttcggac

SEQ ID NO: 1598 - DNA, 1546 bp, Saccharum officinarum
  misc_feature (180)..(180): n is a, c, g, or t
  misc_feature (1441)..(1441): n is a, c, g, or t
caaacgttggggcacatcccactgataaaccgggcccacgagctgctgatggccatccatccgccaacaactcccgttccggtcgccgtcgcgactcacgccgcctcctcgctagccgctacactatctacgccgccacggcacctcccatgagatgagagccgcagccgcagccacatncacagccgccgcgctcctcgccccgggtctaaagctctgcgcgggccgcgcgcgcgtctcctgcccctaccgcctcccactccaccgcgtcgccgccatggcctccgcccccaactcctccttccgcccggaggaggcgcgctcccctcccgccctcgagctcccgaccccgccgctctccaagttcaaggtggcgctgtgccagctctcggtgacggcggacaagagtcgcaacatcgcgcacgcgcgcgcggccatcgagaaggcggcctccgacggcgccaagctcgtgctcctccccgagatatggaatggtccgtattcaaatgacagctttccagagtacgccgaggacattgaagctggcggagatgcagccccttcattttcaatgatgtcggaggttgctcgcagcttacaaatcactcttgttggtgggtccatagctgaacgttctggcaacaacttatacaatacatgctgtgtctttggctcagatggccagcttaagggtaaacatagaaagatccatcttttcgacattgacattccaggaaagatcactttcaaggaatcaaagactcttactgctgggcagagccctactgttgtagacacagatgtcgggcgcattggtattggtatatgctatgacatccgtttccaggaattagcaatgttgtatgctgcaagaggtgctcatttgttgtgctatcctggtgcattcaacatgactactggaccactgcactgggagttgctgcaaagggcgagggctgcagacaaccagctgtttgttgcaacttgcggtccagctcgagataccagtgcaggttatgttgcttggggacactccactcttgttggaccttttggagaggtgattgcaacaactgagcatgaggaggtgactgtaatagcagatattgactattcactgattgagcagaggaggcaatttcttcctctgcaacaccaacgccgtggcgatctctatcagctggtagatgtccagagactgggttcgcagtagcgagcctggattcagctgtgagcctgtgcagttgactctgcaggcttgctcgtactacttcgtttatgagatgcatgtccatgccctgtctactgtctagagatcgatcaacctgatgtgtgaaggtggagaggacggagtaaggcgactatagtttgtaccttcagtgtaagtgtctcaagttgccaaataaattgattacttgaacgtacgaagaaaacctctctncatgaaacaaagataaacggaggatttgctccgatttccctttgggcccttcactttgaaattgaacaacttgggcccaccctgaactgattggcaataaacctc

SEQ ID NO: 1599 - DNA, 1397 bp, Triticum aestivum
gtcacccgatgagagccgcggccacatccacagccttctccctcctctcgccctcccgcctccggacctccgctcccaccaccaccagcctcccctaccgccgtcgtccccgcatcgccgccatggccaccgccgccgcctccttccgcccggaggccgcgcgctcgccccccgccgtcgagcccccggccccgccgctctccaagttcaaggtggcgctgtgccagtctcggtgacggcggacaaggctcgcaacatcgcgcgcgcccgcgccgccatcgagtccgccgcggccgacggcgccaagctcgtgctcctcccggagatatggaacggtccatattcaaatgacagctttccggagtatgctgaggacattgaggctggtggcgatgcagctccttcattttcaatgatgtctgatgttgctcgcagcttgcaaattactcttgttggtggatccatatcagaacgttctggtaacagcttgtacaatacatgctgcgtctttggttcagatggcaagcttaagggtaaacatagaaaggtccatctttttgatattgatattccaggaaagattacattccaggaatcaaaaacccttactgctgggcaggatcttactattgttgacacagatgtaggccgaattggtataggcatttgctatgacattcgtttccaggaattggcaatgttgtatgctgcaagaggtgctcatttgctatgctatcctggtgctttcaacatgactactggaccattgcactgggagttgcttcaacgcgcaagggctgctgacaaccagctttttgtggcaacctgtgctccagctcgagatactagttcaagctatgttgcttggggacattccactcttgttggaccgtttggtgaggtgatcgccacaattgagcatgatgaagcaactataatagctgagattgattattcattgattgagcagaggaggcaatttcttcctctgcgacaccaacgacgtggagatctctatcagttggtagatgtccagggatcgggctccaagtagactgtccgcgttgctcgggtatgcatgatcagtgaagcaagaccttgtacaatggcctgagttgccaaataatcaaacccctttggcaggaataaaaatcgaaaactgcactctaatctgttgggttacttgtgttatggttggagatgaagcaaacatgattgcttcttccgatctctttttagccttatataataatgcagggttacattacacgagtggagtgagttgaagaacatggaaggcacggagatggctgtcctggatcagatgtaccccatgttttcggcttatttttgggccttacgtccgtggctgctataaatgagtaatgtggcaggcc

SEQ ID NO: 1600 - DNA, 2765 bp, Zea mays
ccccaccccaccccacccgcgccgagacggattggaggaggaaccctaccatatcaatctcgcttctcgcctcgtttcgtctcagctgcattccaattccacctgtaagcggagagccttcgtggtccctgctcggttcatcagaatacaggaggcaccggaggtagtccaccaaaacaaaacaccactccatctctcctcttcccagcgatttcctcttcccctcctcgcccgccgagaggccgcccgtcctccgtccgccgtcccagcgagagctttaagattgtgcagacacataatttggatgctcctgcctatgcaagatgtcaaccaccagagatattgtttagtgctgggaaagttatgcagttttggatcataaattctacatagacaagataattatggaccgtgcagacacatcagggtttgtcagtggtggttgctttggtactacactcctgctgatattctttcatttcgtctattctacagtccgtgtctgaaaaatcgtcagtaacgctgcagctgcctgggcagaaatatcatcaggccccctgttctttgagatctctggtgttttatctcattttcttttccaccatcggtatattgtcttaactgtgatggataacggcttcatggacatcccccatccgcctctgatgaatgacccttttgtgttagtgggatgctcagcgccaagctccacggtggagaacatgggccaaagcacactctgtatggatggcctgaacccagcaattgttaattgcagccatgttaatggaaatacacagataatgaatgacataacagcgagagatgatggcagcaggttagtccttggtttgggtccaacaccgaatttttattctgcagtgtccactggctcaaaacaagctcagagattgtcaggccagagttcaactttcactgattcagggatgctgaggcttggccttcacaccgatggtgggggagcaattcaatgtctgcaagcaccgaatggagcactccattctttaggtattgtcgacgaggcttcaacatctactactgtaaggagcatgggtggttacatgccatccctactctttgctccccgctccaatcctactgtcaatgagacacaagtagaaatcccagattctctaaacctcacgcacagcaccagcaacagtcagcatattcaacgtcacctccagtttagccctgaaccctctgcaatgaccgagtcttcatttggtgtgagttctgatgttgtcaccgcaacaactacatcagaacgtagccattctcgacatcctaagaaatgcaggttcaagggatgttccaaaggtgcaagaggcgcatcaggattgtgtattgctcatggaggtgggcagagatgtcataaacctggatgccataaaggagccgagagcagctctgcatactgcaaagcccacggtggcggtcgtcggtgtgaggaacttggttgtaccaaaagcgcagaaggaaaaacagattattgcattgctcatggtggaggccgccgctgcgaacatcctggctgtcctaaagctgcccggggtaagtctgggcggtgcatcaagcatggtggtgggaagaggtgtttggttaaaggttgcattcggagtgcggaggggaaggctggattgtgcatttctcatggcggtggtcgacggtgccagtatccagattgtggcaagggggcacagggcagcacattgtactgcaagggacatggtggtggcaagaggtgcgtcttcgatggttgcagcaaaggcgcagagggtagcacacctctgtgcaaagcacatggtggcgggaagcggtgcatgtttgaaggaggtggtgtctgtgcaaaaagtgtgcacggggctactgaatattgcgtggcgcatggaggaggaaagcgctgttccgtgcccggctgcaccaagagtgctcgtggccgcactgactgctgtgtgaagcacggtggcggcaagcggtgcaaggttgagaactgtggcaagagcgcccaggggagcacggacttctgcaaagcccatggcggaggaaagcggtgcacatggggcacaggctgtgaaaaattctcccgtggcaagagtggcttctgtgcggcacatggtaccttgatggccaggcagcgagaacaagaggcggcgaagaatgtaggaagcatgattggaccaggtctcttcagcggcattgttgtgtcatctgccaccgcagcaagcagcatgacgaacgagcactcgtcctctggtgtcagcaccgcttccgactgcgacggcactgtgaggagccaatcaatgattcctccacaggtgctggttcctcgctctatgatgccttcttggtcgactgagcctgtagatggaggcagagagggaggtcatgttgttcccgaggggagggtccatggtggtggcctcctgtcacttatcggtggcagcttcaggaacgccgatttggagaagcttcaaagctagtgcttttccatcagcagattcggtcagtttgtttgtacataaacaggccgcgtttcggcctattgtattcttattgtgccttttcttgtctagataaacatttcaaccttcatgtactggtttaagtccattgtaaagtggtgactggcaattgttgtgaacgcttttggcttgttggttcagctgtagtcagtactgcaataatttcgtgtgttgtttaagctgctcttatttgtttgtgcatattcttgtttggatttt

SEQ ID NO: 1601 - DNA, 2797 bp, Sorghum bicolor
ggtccccctgctctgctcatcagaatttcagaatataggaggcaggccgccgcccggcaagtccaccgaaacaaaaacactactccgcctcgcctccctctccgcctctcttcccagcgacttcctcctccctccccctccagccctcctcgtcgtccggcgaggcagcagcgagatcgaccgtcctccgtccccgcgcgagattgtgaaaccacagaatttggatgctcctgcctatgcaagatgtcaaccaccagagatattgttcagtgttagggaagttgtgcagttttggatcataaattctacagaaacaagataattatggaccgcgcagacacatcagggtttgtcagtggtggttgctttggtactacactcctgctgatattcttccatttcgtctattctacagtccgtgtctgaaagattgtcaagaacccttaagctgcctgggcagaaatatcatcaggcccctgttctttgagctctctggtgttttatctcatcttcttttctgccattgctatagcgtctcaactgtgatggataacggcttcgtgaacattccccatccgccattgtcagaggctctgatgaatgacccctttgttttagtgggttgctcagcgccaagctccacgatggagaacatgggccaaagcacactctgtatggatggcctgaacccagcaatggttagttgcagccatgttaatggaaatacacagataatgaatgacatagcaccgagagatgatggcagcaggttagtccttggtttgggtccaacaccgaatttttattctgcagcgtccactggttcaaaacaagatcagaggttgtctggccagagttccactttcactgattccgggatgctgaggcttggtcttcagatggatggtggggaagcaattcaatatctgcaagcaccaaatggagcactccattctttaggtgtcgttgatgaggcttcaacatctgctactgtaaggaacatgggtggttacatgccatccctactctttgctccccgtgccaattctactgtcaatgagacacaagtagaaaccccagattctctagacctcacgcacagcaccagcaatagtcagcatgttcaacatcacctccagctcagccctgaaccctctgcaatgaccgagtcttcatttggtgtgagttctgatgttgtcactgcaacaactacatcagaacgtagccattcccggcatcctaagaaatgcaggtttaagggatgttccaaaggtgcaagaggcgcatcagggttgtgtattgctcacggaggtgggcagagatgtcataaatctggatgccataaaggtgccgagagcagctctgcgtactgcaaagctcacggtggcggtcgtcggtgtgaggagcttggttgtaccaaaagtgcagaaggaaaaacagattattgcattgctcatggtggaggccgccgatgtgaacatcctggctgtcctaaagctgcccggggtaagtctgggcggtgcatcaagcatggtggtgggaagaggtgctcggttaaaggttgcattcggagtgccgaggggaaggctggactgtgcatttctcatggcggtggccgacggtgccagtatccagattgtggcaagggggcacagggcagcacattgtactgcaagggacatggtggtggcaagaggtgcatcttcgatggttgcagcaaaggcgcagagggtagcacacctctgtgcaaagcacacggtggtgggaagcgatgcatgtttgaaggaggtggtgtctgtgcaaagagtgtgcacggggctactgaatactgtgtggcacatggaggtgggaagcgctgttccgtgcccggctgcaccaaaagtgctcgtggccgcactgactgctgtgtgaagcatggtggtggtaagcggtgcaaggttgacaactgcggcaagagcgcccaggggagcacggaattctgcaaagcccatggtggaggaaaacggtgcacttggagcacagggtgtgaaaagttctcccgtggcaagagtggcttctgtgcggcacatggtaccttgatggccaggcagcgagaacaagaggtggtgaagaatgtaggaagcatgattggaccaggtctcttcagcggcattgtggtgtcatctgccactgcagcaagcagcatgacgaacgagcactcgtcctctggtgtcagtaccgcttcggattgtgacggcaccatgaggagccaatcaatgattcctccgcaggtgctggttcctcgctctatgatgccttggtcttctgagcctgtagatgggggcagagagggaggtcatgttgttcccgaggggagggtccatggaggtggcctcctgtcactactcggtggcagcttcaggaacgctgatgttgaaaagctttgaagctagtgcttttccatcggcagatttggtcagtttgtacataaacagggcgtgtttccgcctattgaattcctattgtgccttttcttgtctagataaacatttcaaaccttcatgtactggttaagtccattgtaaagtggtgactggcaattgatgcgaacgcttttggcttgttggttaagttgtagtcagtactgcaataaattcgtgtacttattatgctgctcttatctgtttgtgcgcattcttaagaaactcgtctagactttccattgcgaagtgttggatgccaattttctgaaacctgaaattttgcatcacgtcggtccaggttatatttgttctgttctgaaacctgaaattgtgca

SEQ ID NO: 1602 - DNA, 1890 bp, Panicum virgatum
ctttgtcgtcagcttcccccacccttcccctgcgcggccaccgcacctcagcgaagcgctcggccgtgtttctctcgtctcgtctcgtctcgctccctcgcattcgcatcgccgcccctcccatcattcagcgctcgtcggactccgccgcccgcaattcccctctgcccccggcttttaatgggctttccctcccaccgacatggccggcgatccccgcacccgcgccgccggtgaccgccccgcctccctctccctcgccgcagccgctgcaggaggcggacccagacccagcctcggcccctccagcctcctgctccacctgctcctcctccactcgctcttatagccccatcaggcgtcacgcgcgcgcccgcatatggccgccgtcttcttccaccacgtcgtcggcgacctcaccgtcggcaagccggaggtcgcggagctccacgacaccgaaacgctcgatgacgccgcgcgcgccatcgcttccagccccgagggcgccgtgccggtctggcgcccgcgggccacgcccgacgacccgccgtccggggccaggttcatcgggatgatctccgcgctcgacatcgccgcgttcgtggccgccgcagggatcggggaccgggccatgcgagcggtcgtcggcgaggtcgttcagcccaatcccgagctgctcagggagatcgatcccgggtaccacgctgattgatgcactgggagctcatgaggcatggagtgaagcgcttccttgttcgcaaggagtgggagctggaaaggcattaccaagaggtttttcagtgctttataatggcaagtggctgaagaatatggaatcaacttctccaaatgcagccagcagcagcagacagctgtcctcatctatgggtttagcagacaagttttgctgcctttcaagggaagatgttctccggtttctaattggatgccttggagctcttgcgcccatcccactgactcagatatcttccctcggagtcatcaatccacaatattgttatgtagaagcatctgcgcctgccatggaagcaattgagaagatcccgcaggacccatgcgccgttgctgtagtggaaacgatgccagatggaactcgtaagatactaggcgacatatctacttacaaactgtggaaatgtgactatgtttcagcagcatgggcgctggcaaacctgtcagccgggcagtttgtcattggcgctgatgagaatgcagcgatgtccatgtctgtcctcccggagcctcctgtcagcccatcatcaccagtggaagaaatcagtcctgggcgctcacccagggcgaagaagttcagcagcaggagcatcggtttccaggcgaaccagatgtcggcgtggcggatgcggagctcgttccaccggggcaggagcacgccactgacctgcaagagcacgagcaccctcgcggcggtcatggcacagatgctgtctcaccgggccacgcacgtttgggtgacggatgcagagtcggaggaggacggcgttctcgtcggcgtggtgggctataccgatatcttcaatgccgccacccggagcacctgctccagcccgacaacttcttgatggcttgatgcaccacaccgtaatgtacagtactgtgcttggttgattcgttggtggtcgcccctgggtgcacgctttgcaccgaactgtaaactgcacttggttagtctgttggttcgtttggagagttttagatattcttggtctgcatagcgcaggacttggtggtatattgttgcattcgttggacggttcaaataaggattgggacttgcctgggagtccactccattttgcatgctcccaaatgtacgtatggatgttagcttgctctttccatgtatagagt

SEQ ID NO: 1603 - DNA, 1373 bp, Sorghum bicolor
cacagccgctggtcactgcactgggcaacccagcgcagctaacactcctatacaaatatccgagctactactcttagtacaagctacagaggcagatcgaagcacaaattaaagctgcctgtagatagcaaccatcaacagtgaccgatcgaagtagtagtgagcaactgagcatctatcagtcgatctagctacgtacatagaacacacagctgcagcagctcgatctcttcttgctgtccctgcggtgggttttggagtgtaatctgctcgagtagctagctagctgaagaaccatgggctgcgaggaggaagagaggctgctgttcccgtccttcgtcttccccgagagcttcgcggaggccgccacccccggctccggtggtgagcagaagaaggctcggcagcggcggaggcggaagccgcggccggcggcggatggcggcgagggcggggacgagcaggccaagaagcggcggctgagcgacgagcaagcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccagaactgccacctcgagaccgagctgctgaagatgaaggacagactggaggaggcggaggaggagaagaggaaggtcatcgcggctgccgcggcagccggtggtggcggcggcggagcgggcgcaggaagcagcagcccgagctcgtcgtcgttctcgacggtgacgcacaacccggcggcgctggtggggcagttcggggtggacccggaggaggccgccgccgacctcacctacatgagcgagtacgcctacaacagctacatgaacatgatggacatggacctcgcgcccggcggctacttcggaggagtagtctacgatcacttcaactgatcgaccgatatgatgagcatgaacgaggaaggattgaccggctatcagctaggtattttcgtgttaatggatggatggatcgatcgatttgcagggcgcgcgtagcagtagtttcaagcaatcaagtcactagtataatcagtacgacgtctatcagtcaatgtcctgacggtgattaagtctattcagtaacttgttaagccatgtagattagtagctggtaatctttgtaaatctgtgtggattatcatgcaagtgcagcttatcatgaactaatggtctctgtgatgtaatattggggggaatgggggtaatcggaatcagaagatgcttgtaaatgttttggcg

SEQ ID NO: 1604 - DNA, 1553 bp, Saccharum officinarum
  misc_feature (236)..(236): n is a, c, g, or t
  misc_feature (280)..(280): n is a, c, g, or t
  misc_feature (1019)..(1019): n is a, c, g, or t
  misc_feature (1045)..(1045): n is a, c, g, or t
  misc_feature (1074)..(1074): n is a, c, g, or t
  misc_feature (1198)..(1198): n is a, c, g, or t
  misc_feature (1217)..(1217): n is a, c, g, or t
  misc_feature (1227)..(1227): n is a, c, g, or t
  misc_feature (1240)..(1240): n is a, c, g, or t
gggcaacccagcgcagctaaaactcctatacttatatccactagtcttagtacagactacagaggcggagcgagcacagattaaagctacccgtagagagcaaccatcaacagcgaccgatcgaagtagtgagcatctgatcatcagtcgatctagctacgtacatagaaacagctgcagcagcgactctcttcttcttgctgtccctgcggaggttttaggagtgtgatctgctngagtagctagctagctgagccatgggctgcgaggaggaagagangctgctgttcccgtccttcgtcttccccgagagcttcgcagaggccgccacccccggctccggtgacagtggtgagcagaagaaggctcggcagcggcggaggcggaagccgcggccggcggcggatggcggcgaggccggcgacgagcaggccaagaagcggcggctgagcgaggagcaggcgcggttcctggagctcagcttcaggaaggagcgaaagctggagacgccccgcaaggtgcagctggcctccgagctgggcctcgacgccaagcaggtggccgtctggttccagaaccgccgcgcccgccacaagagcaagctcatggaggaggagttctccaagctccgcgccgcgcacgacgccgtcgtcctccagaactgccagctcgagaccgagctgctgaagatgaaggacaggctggcggaggcggaggaggagaagacgaagctcatcgcggctgccgcggcagccggcggcgtcggagcgggcgcagctggaagcagcagcccgagctcgtcgtcgttctcgacggtgacgcaccacccggcggcgctggtggggcagttcggggtggacccggaggaggccgccgccgacctcacctacatgagcgagtacgcctacaacaactacatgaacatgatggacctcgcgcccggctacttcggcggagtagtctacgatcacttcaactgatcgatcgatgagcatgaacgaggaaggattgaccggctntcagatcagctaggtattttcgtgtnaatggatggatggatggatcgatttgcanggccgcgcgtagcagtagtagcaagcaatcaagtcactagtataatcagttcgacgtctatcagtcaatgtcctgacggtaattgagtctattcagtaacttgttaagccatgtagattagtanctggtaatctctgtaaatntgtgtggatnatcatgcaagttnttatcatgaactaatggtctctgtgatgtaatattgggggggggtcggtatatgaatcaccttacactcaaacgcctttctagatggccgcaacccgccctttggccgattaccaaccaccgtatcgtcccggaaatttcttggatcggcgctactcgtgaaccggccggctcgacgatccgtggccggccgtcaatcgcgtaggcgcaattggtcacacaacgcgccgtctgacagatgcagcaactctcactccgcacgcacacacagcagccccccctagagtgccacccagacgattcgcgcacactca

SEQ ID NO: 1605 - DNA, 1279 bp, Panicum virgatum
  misc_feature (57)..(57): n is a, c, g, or t
  misc_feature (94)..(94): n is a, c, g, or t
  misc_feature (539)..(539): n is a, c, g, or t
  misc_feature (1026)..(1026): n is a, c, g, or t
  misc_feature (1085)..(1085): n is a, c, g, or t
  misc_feature (1095)..(1095): n is a, c, g, or t
  misc_feature (1199)..(1199): n is a, c, g, or t
acagctagctagctgctcacactgggcaacccacccagcgcctatagaaatatccangctactgctacggagagagcgggcagcacaaaagccntctagctggctagcaaagcagccatttttgaaaggcgatcgatcggagcggtgagcattagtccatcgatctgcgcacggggaacagctgctgcagctccatctccctgctgtttctgtagagtgtgatctgctagcttgttggggtagctggaggatgggctgcgaggaggacgagaggctgctgttcccgtccttcgccttcccggcggagagcttcgcggaggccgacacccccggctccggcggcgagcagaagaaggcgcggcagcggcggaggcggaagccgcggccggcgggggagggcgacggcggcgacgagctgtccaagaagcgccggctcaacgacgagcaggcgcggttcctggagctcagcttccgcaaggagcggaagctggagacgccccgcaaggtgcagctcgccgccgagctcggcctcgacgccnagcaggtggccgtctggttccagaaccgccgtgcccgccacaagagcaagctcatggaggaggagttctccaagctccgcgctgcgcacgacgccgtcgtcctccagaactgccacctcgagaccgagctgctgaggatgaaggagaggctggcggaggcggaggaggagaagcggaagctcatcgcggcggcggcagcagcagccgcgggcgccggcagcagcagcccgagctcgtcgtccttctcgacggtgacacaccacccggcggcgctggtggggcagttcggggtggaggcggaggaggccgccgacctcgcctacatgagcgagtacgcgtacaacagctacatgaacatgatggacctcgcgcccggctacttcggcggcgtctacgatcacttcaactgagcgtgcaggagatcaggaaggattattaactggctatcagctagctattttggtgttgatgaatcgatcaatttgcngggcacgtagcagcagcagcaggagcaaccaagtcagtagtagcggtataactagctantagtatgttntatcagtcatcagtgtcctgacgagaattaagtctattcagtaactggttaagccatgtagattagtaactggtaatctatgtaaatatgtgtggattatcatncaagtgcttatcatggactggtgatctctgtgatgtaatattgggggtaatcggaatcagaaaaaaatgttgctttgtgc

SEQ ID NO: 1606 - DNA, 1787 bp, Brachypodium distachyon
gatggggatagtgaggcctgcggatgatgtggaaagcggggtggtgggtgccgggggcggcggcggcgaggtgacggcgccgctcctactccgggatcacaaggatgatgcggcggcggtggaggatgccaagatccaggtggacgagaaggtggattcgtgcggaggcggcccggaagggtccatctggatggttctgctcagcaccgcggtggccgtgtgcggctccttcgagttcggaacctgtgttggttattctgcaccaactcagtcaggaatagtggatgaagtcggactgtccatctctgagttcgctatctttggatctgtattgacgattggggcaatgattggtgctgttactagtgggcgtttagcggactttgttggacgtaaaatgaccatgcggatatcagctactatttgcatttttggttggctgtctatatattttgctaagggtgctactatgctctactttggaagaaccttgctgggctatagcactggagttctttcttatgtggtgcctgtgttcatagctgagatagcaccaaagaatctcagaggaggccttgcaacttcaaaccagttgttgatctgttctgggagttcagctacttacataacaggggcgctggttgcatggcgcaatttggtattagttggtatattgccatgtgttctcctcttagcaggtctcttcttcattccagaatcaccgagatggctggctaatgttggaagggagaaagaatttcacacctcattgcagaagcttcgtggagagaaagctgacatatctgaagaggccattgagataaaagagcatattgaatcagtgcagagcttcccaaaggccagggttcaagaattgtttctgagcaaaaatatatatgctgtcattgtgggcgttggcttgatgatcttccagcaactgggagggataaatggtgtaggattctatgcgagctatatctttacttctgcgggattttctggaaaacttggaaccatcttgattggcattattcagattcccattacattgtttggcgccatcctcatggatcggagtggaagaagggttcttctaatggtatccgcatctggaacgttcctgggctgctttatgacaggaatatcattctacctaaaggcgcacggactattcctagaatgggttcctgcattggctgtttctggcatacttgtttacataggtgcatactcaattggaatgggacctgtcccttgggttatcatgtccgagatattctcgattaagatgaaagcgatcggtggaagcttggtgacacttgttagttggtttggttccttcgtgatctcttactctttcagcttcctaatggactggagctcagcaggcacgttctttatgttctctgcggcgagcatgctgactatattgttcgtggtgaggctagtgcctgaaaccaaaggcagaactctcgaggagatccaggactcgctgaattccagaagataagggtcaatggaaactaaaccaaaggcagaacactcgaggagatccaggactcgctgaattccagaagatagggtcaatagaaactatacatgcatcccttactccatttctcaccgtggcagcatatatacatcgattttctttggttgtttttctccctatgatagctttcctctcgggtgtagtgttgaagtgtatttgtaggttaagtatgcgcagattatgtaccaagtttgataagacttttaagtaatagatcatttctggcctttttgag

SEQ ID NO: 1607 - DNA, 2028 bp, Oryza sativa
cgagagggagagagagagatcccgagctcccgacccgagcgacacgctcgcgctccttgccaatcttgggcctcccgagttttgctgccattgccgctcgctgctgctctcgagtgcgcgcgtgcgtgcgtgcgtgttgcgccggggggaatggggatagtgagagccgcggaggatgtggagggcgcggtggtggccggagccgcgggcggcggcggcggaggcggaggcggcgaggtgacggcgccgctgctcctccggcagcacaagcaggggcggggcgatgaggagaagatccagaatgatgcgggcggcgatggcgggggtcggcgcggaggaggaggaggagggtccatgtcgatgctgatgctctccaccgccgtcgccgtgtgcggctccttcgagttcggcacctgcgtgggttattctgcacccactcagtcagggattgtggatgaagttggactgtccatttcgcagtttgcactattcggatctgtactgacgattggggcaatgattggtgctgtcactagtggtcgcttagcagattttcttggacgtaaaatgacaatgcggatatcagctactatttgcatttttggatggctttctttgcatttggctaagggtgttatcatgctctactttggaaggatattgttgggctttagtactgggattctttcttatgtggtgcctgtgttcatcgctgaaatagcaccaaagaatctcaggggaggccttgcaacttcaaaccagttgctgatctgttctgggagttcagctacatacataattggcgccctggttgcatggcgtaatcttgtgttagtaggtatagtaccatgtgttttgctattaacaggacttctcttcattccagagtcaccaagatggctggctaacgttggaagggagaaagaatttcatgcctcattgcaaatgctacggggagaggatgctgacgtttctgaagaggccgtcgagattaaagagtatattgaatcactccataggttcccaaaggccagggttcaagatttgtttctcagaaaaaatatatacgctgtcactgtgggtgttggcttgatgatatttcagcaattaggagggataaatggtgtaggcttttatgcaagctctatcttcacttctgcaggtttctctggaaaacttggaaccatcttgattggcattattcagattcctattacattgttcggagccattctaatggataagagtggaagacgggttcttctaatggtctcggcatccggaacatttttgggctgctttctgacaggaatatccttctacctaaaggcacaagggctattctcagaatgggttcctgaattggctcttaccggtatactggtttatattggagcatactcgattggaatgggccctgtcccttgggttgtcatgtctgagatattctcgattgacatgaaagcaatcggtggaagcttggtgacactagttagttggttaggttccttcgcgatttcttactcgttcagcttcctcatggactggagttctgcagggaccttcttcatgttctccgcggcgagcttgatcaccatcctgttcgtggtgatggtcgtgcctgaaaccaaagggaggacgctcgaggagattcaggactcgctcatcgactccagatcaagattgagggatccatagaccatagagatatgatccacttgctccactctttctacctgagccgccgtcaaattcgacgcacctctctctctcactctctctgtctctttagcctcctgatctttctctctccggttcttggcagttttgccgtagtgtactcaatacctagctaggctaagtcccgggctactacgcatgcaagctatgtataccatgtcactctgaattgtattgagcaatatatatatgggacacacacacatatgtgtgttctgaggctttacgctgttttgtcgtgagtatactggtctatccgtaagaaaggtactccctatgttccatata

SEQ ID NO: 1608 - DNA, 1988 bp, Sorghum bicolor
tcatctcacgtcggtagcaacacggaacacgagaacaatgggcatagtgcgggccgcggacgatgtggaggccggagtggtcggggccgccacgacgacgacgacgacggagccgcttctcctccgccactgcggcaaggaggaccacgataagatccggggcagcccggaggaggcggcggcgtccgactgcgggagcgaggaggggcggcccgacgcagcaggctcgctgcggatggtccttctctccaccgccgtcgccgtctgcggctccttcgagttcggcacctgcgtcggctattctgctcccacgcagtcagggattgtagatgaagtcggtctatctatctccgagtttgccatctttggatctatattgacagttggagcaatggttggtgctgttactagtgggcgcttggctgattttcttggacgaaaaatgaccatgcggatatcagctactatttgcatctttggttggctttctatacatctggccaagagcgctatcatgctctactttgggagaatcttactgggtttcagtactggagttctttcttatgtggtgcctgtattcatagctgaaatagcaccaaagaatctccgtggggggctcgcaacatcaaaccagctcttgatctgttctggaagctcagctacctacatcataggagccctggttgcgtggcgaaatttggtacttgttggtttattgccttgtgttcttctgctagccgggctttacttcattccagagtcaccaagatggctggccaatgtcggaagggaaaaggaattccacacctcattgcaaaagctgcgtggacaggatgctgatgtatcagaagaggcaattgagattaaagagtacattgaatcactccgtagctttccaaaggccaggcttcaagacttatttctaagcaaaaatatatatgcagtcattgtgggtgttggcttgatggtttttcagcaactcggagggataaatggtgttggattctatgcaagctatatcttcagttctgccgggttttctggaaaacttggaaccatcttgattggcattattcagattccaattacattgtttggggccatcctcatggataggagtggaagaagggttctcctgatggtctctgcatctggaacatttttgggctgcttcctcactggagtatcattctatctaaaggcacaaggacttttcccagaatgggttcccacattggctctttctggcatactggtttacatcggggcatactcaattggaatgggtcctgtcccttgggttgtcatgtctgagatattctccattaacatgaaagcaattggtggaagcttggtgacccttgttagctggctgggttccttcgcgatttcttactcgtttagcttccttatggactggagctctgcaggtaccttcttcatgttctctgcggccagcttggtcactgtattcttcgtggcgaagctggtccctgaaaccaaaggaaggacactagaggagatccaagactctctaaacaccagaagataaaaatgaatttactgcacactacagaagtattccaagatggaaaatgggaatttacaggacacaacagaataattctaagatggaaaatgatgtccacgtttacctttcccaccttcaccgtgtgctcaaccgtcagacttctgctcatagaagaaacaatacaattttcacctccccccgcttctcctccccttctctcctgctcacctccgtgtaatatgtagtgtaccctatgtaggttaaggactgcagattgagattatgtagtattattaagtatcatgtccctccagattgtttgagcttgagcagcaactgaaccgacattatgtaccatgtccctctagatcaatcagcagtacatttttatattcatgatcaacatttttgtatcatgtccctccagatcaatcagcaatgcatttttatattc

SEQ ID NO: 1609 - DNA, 2036 bp, Brachypodium distachyon
atggctctcgcgcgaaccctcccgctcccgcacctcgctccggccccggcctcgcccggccgcctccgcggctgcatccgcgtcctccccgcattgtcctcccaggcgggcgcaccccccgcggcgcgagggatcgcctgccgctcctcgaaggcgacgacgatgacgacaacggcggcggaggtggcggcggtgggcgtcggggaggagcttcccgaggggtacgagcagatgatgccgaccgtggaggagtcccggcggcggcgcgcgggcgtgctgctgcacccgacgtcgctccgcggcccgcacggcatcggcgacctcggcgacgaggcgctcgccttcctccattggctccgcgacgccggatgcacgctctggcaggttcttccacttgttcctcctggaagaaaatccggggaggatggttctccttattcaggacaggatgcaaactgtggtaataccctattgatttctcttgaagagcttgtaaaagatgggctcttgatggaagatgaacttcctgcacccttggatgtggaatatgttgaatttgacactgttgctaatctgaaagaacctcttattgcaaaggcagcagagaggctcctactgagtcatggagagctcagaatgcagtatgacgaattcaagagaaatccagatatttcaggctggcttgaagatgctgcactatttgctgctattgacaaaagcattgatgcattgtcctggtatgagtggcctgaaccactgaaaaatcgccatcttggagccttggaagacatatatcaaaaacagaaagactttatcgagatttttatggcacagcagttcttatttcaaaagcagtggcaacgtgttcgtacacatgcacagaagctgggcatcagcataatgggcgacatgcctatttatgttggctaccacagtgcagatgtttgggcaaacaggaaatcatttttgctggacaagaatggtttccccacatttgttagtggtgttccacctgatgcatttagtgaaactggtcagctatggaacagtccactgtacgactggaaatttatggaagctgatggttttacatggtgggtaaagaggattaaacgtgcccttgatttgtacgatgagttccgtatagatcatttccggggacttgctggtttttgggcagttctgtctgacgcagaagtagcgatggttggaagctggagggctggaccgaggaatgccttttttgatgcgctcttcaaagctgttggtagagcaaatataatagcagaagacctgggcgtgataactggagatgttgttgagctaaggaaatctattggggctcctggaatggcagttcttcagtttgcttttagcggtggttctggcaacccccacttgcctcataaccatgaactgaatcaagttgtatacactgggacacatgataatgatacggttgttggctggtggaagagtttgccagaggaagagaagcagactgtgctcaagtatctaccagaggccagcaagactgatgtctcgtgggcactaattactactgccctctcttcggttgcgaggacttccatggtaaccatgcaggacatacttggcctcgacagttctgctaggatgaatactccagctacacagaaaggaaattggagatggaggataccaagctccgtcagctttgacagccttaaccctgaagcagcaaaactgaaggagttgcttgcattttacagccggctgtgaagttcccagttctccagtactattctctgtcgcttgaggctcggaactgttggatgtttccatcataaattagcagccaaagtaacatcaacgatttggttgctatcatctcccctgatattggcacctgtgcgcgaataacaggggtcgcaccatgttttcatcggttgcaaacttgcatgcttcaacttgaagatcttgcaggtttacaactggctattccataatactaataaaggttgccttacataaaaaatatgagccgtatttttttt

SEQ ID NO: 1610 - DNA, 2236 bp, Sorghum bicolor
gacatgcggggctcacgtgtcattccccaccgcccatatctccccctctccgcctcggccccttcccctccccgccccgcgcgcctgtcccgtccgttggtcgcaaatggttctcgcgcgagtcctcacgctcccgctgcccgccccgtcgtccgcgccccaccgccgcttactcctgccgcctcaggcgtcgccggcgcctgcgcgtgtgcgcaccgtgcgggccgccgcctgccgtgcagcgaacgccatggcggcggtttctgtggacccgcccccggtcgctccgagccccgcagaggtcgcggccgtgggcgtcggggatgagctgccggaggggtacgatcagatgatgcccaccgtggagccgtcgcggcggcggcgcgcgggggtgctgctgcatccgacgtcgttgcggggaccgcacggcatcggcgacctcggggacgaggcgcttgccttcctgcattggctccgcgacgccggctgcacgctctggcaggttctaccacttgtccctccaggtaggacggctggggaggagggatctccttattctggacaggatgccaactgtggcaatacccttttgctatctcttgaggagcttgtaaaagatggtctattgatgtcagatgaacttcctgatcctgtggatacagagtatgttgaatttgacactgttgcaaatctgaaagaaccacttattgcaaaggcagcagagaggctcctactaagccatggagagctcagaacgcaatatgactgcttcaagaaaaatccaaatatatcaggcaagaattttttatgcataaactttcaaacaatgtttattagcctttcatattgttggcttgaagatgcagctctttttgctgctattgacaaaagcattggtgcattctcttggtacgagtggcctgaacctctgaaaaatcgccatcttggagccttggaagatatatatcaaaaacagaaggactttatagagacatttatggctcagcagttcttatttcaaaggcaatggcagcgggttcgtaaatatgcacaaaagctgggtatcagcatcatgggtgacatgcctatatatgttggctaccatagtgcagatgtttgggcgaacaggaaatcatttttgctggacaagaatggtttccccactttcgttagtggtgttccacctgatgcatttagcgaaacgggtcaactatggaacagtccattgtacgactggaaagctatggaagcagatggcttttcatggtggacaaagaggattaaacgtgcccttgatttgtatgatgagttccgtattgaccatttccggggtcttgcaggtttttgggcagtcccttctgatgcaaaagtagcactggttggaagctggagggctggaccaaggaatagcttttttgacgcgctcttcaaagctgttggtagaataaatataatagcagaagacctgggggtaattactgaagatgttgttcagctaaggaaatccattggggcccctgggatggcagttctccagtttgcttttggaggtggttctgacaaccctcacttgccccataaccatgaaatggatcaagttgtgtacactggaacacatgataacgatacagttcttggctggtggcaaaatttgccagaggaagagaagaaaattgtgatcaagtatctaccagaagccgagaatactgacatatcatggacactgattacggctgccctctcttctgttgcgaggacttccatggtaaccatgcaggacattcttggcctcgacagttctgctcgaatgaatacgccagctacccagaaaggaaattggaggtggaggatgccaggctcagttggcttcgacagtctcagccctgaagcggcaaagctgaaggagctgcttgcgctgtacaatcggcagtgaagtccccgaagtccctttaataaaataggcaaccaaatgtgagcggtttggctgccaagttctatgggaccatggtactcggtcccgcacaaacgttttgtgttctggttggctagaaacttgcgtgcttgaatatgaaggtcttgcactgcaggttgaggcctgaacacgaagtattgtactgtgtattcccattttttaacaatttcctttatgtgcgggcctatacaagtttccccccacttcgcaacaagcgtttaccagtttggatctgtttccttctgctgacttgggcctcgtttg

SEQ ID NO: 1611 - DNA, 1815 bp, Panicum virgatum
ggccgtgggcgtcggcgaggagctgccggaggggtacgatcagatgatgcccaccgtggagccggcgcggcggcggcgcgcgggggtgttgctgcacccgacgtcgctccggggcccgcacggcatcggtgacctcggcgacgaggcgctcgccttcctccactggctacgcgacgccggctgcacgctctggcaggttctgccacttgttcctccagggagaacatctggagaggatggatctccttattctggacaggatgccaactgtggtaatacccttttgatatctcttgaagagcttgtaaaagatggccttttgatggaagatgaacttcctagctccgtggatgtggagcatgttgaatttgctaccgttgcaaatctgaaagaacctcttattgcaaaggcagcagagaggctcttacttggccaaggagagctcagaacgcaatatgactgcttcaagaaaaatccgaatatatcaggttggcttgaagatgcagcactttttgctgctattgacaaaagcattggtgcattttcttggtacgagtggcctgaacctctgaaaaatcgccatcttggagccttggaagatatatatcaaaaacagaaggacttcatagagacatttatggctcagcaattcttatttcaaaggcaatggcagcggattcgtaaatatgcacagaagttgggtatcagcataatgggtgacatgcctatatatgttggctaccatagcgcagatgtatgggcaaacaggaaatcatttatgctggacaagaatggtttccccacttttgttagtggtgttccacctgatgcatttagtgaaactggtcagctatggaacagtccgttgtacgactggaaagctatggaagcagatggcttttcatggtggataaagaggattaaacgagcccttgatttgtatgacgagttccgtattgaccattttccgggggcttgtgggtttttgggcagtcccatctgatgcaaaagtagcactagttggaagctggaggtaggctggaccgaggaatgccttttttgatgcgctcttcaaagctgttggtagcataaatataatagcagaagacctgggggtgattactgaagatgtggttcagctaaggaaatcaattggggcccctgggatggcagttctccagtttgcttttggaggtggttctgataaccctcacttgctgcataaccatgaaatggaccaagttgtgtataccggaacacatgataacgatacagttcttggctggtggcaaaatttacccgaggaagagaagcaaattgtgattaagtatctaccggaagccaagaatactaacatctcatggacaatgattactgctgccctttcttctgttgcaaggacttccatggtaaccatgcaggatattctgggcctcgacagttctggtagaatgaacactccagctacccagaaaggaaactggagatggaggataccaagctctgttggcttcgacagccttagccctgaagcagcaaagctgaaggatttgcttgcgctgtacaatcgtctgtgaaggccgtgacattatgttctacggtcagaagctcctttcataaaatggcagccaaatgtggggctgctaagttctatgcgactaatacctgtccccgaataagcgtttcgtgttctggttggccggaagcttgcgtgcttgtacatgaaggtcttgctttgcaagttaaggcttgatgaatatgaagcactgtatgtgtattcacaatttaattaggcatttctttcttgaggttcta

SEQ ID NO: 1612 - DNA, 1580 bp, Sorghum bicolor
ggttggaccctggtctttcgaccaccactgccatcgcagctctcctcgtgccgatcagcgccatgcggccgtcatcgtccatagcatcgtcgaggggcacagcggcgccgcgcatgtacttcatcccgttcccgacgccgggccacgcgctgccgatggccgacctcgcccgcctcttcgcgtcccgtggcgccgacgccacgctcgtcctcacgcgcgccaacgccgcaaggctcggtggccccgtcgcccgcgcggccgccgcgggcctccgcatccgtatcatcgcgctcacgctgcccgcagaggccgctgggctcacgggtggtcacgagagcgccgacgaccttcccaaccgcgagctcgccgggcctttcgccatcgccgttgaccttctcgcgccgctcttcgctgatctcctgcgccgccagcctgccgacgccgtcgtgttcgacggcgtcctcccgtgggcagccactgccgcctcggagctcggcatcccgcggtacgcgttcaccggcacggggtgcttcgcgctctcggtgcagcgtgctctgctgctccacagcccgcagaatggcgtggcgtccgacacagagccgttcctcgtcccgggcctccccgacgcggtgcggctcaccaggtcgaggctcgccgaggcgacgctcccgggcgcggactcgcgtgagttcttgaaccgcatgttcgacgccgagcgcgccacgaccgggtgggtcgtcaactccttcgctgacctcgagcagaggtacatcgaacactacgagaaggacacggggaagccggtgttcgccgtcgggccggtctgcctcgtcaacggcaacggcgacgacaccctggagcgcggccgcggcggggaggccgaaacggccgtcgaggccgcgcgcgtgctgaggtggctggacacgaaacccgcccggtcggtggtctacgtctgcttcggcagcctcacccggttcccgcgggatcaggtggccgagctcggcatgggcctcgcggactccggcgcgaacttcgtgtgggtcgtcggggacaagaacgcgccgccgccgctcccggacatcgacggcgcggcgccgggccgcgggctggtggtcagggggtgggcgccgcaggtagcggtgctgcggcacgcggcggtgggcgcgttcgtgacgcactgcgggtggggtgcggtgaccgaggcggcggcggcgggcgtcccggtgctggcgtggccggtgttcgcggagcagttctacaacgaggcgctggtggtggggctcgcgggcacgggcgtctccatgggcgcggagagggggtacgtgtggggaggcgaggcgctgggcggggtggtggtgggcagggaggcagtggcggagcgggtgcgcagcgcgatggcgggcgaggcgctgcgggggagggcgcgggaggtcggcgagcgcgcgcggcgcgcggtggaggcgggaggatcctcgtacgaggccgtgggcgcgctgctggaggatgtgctgcggcgtctcaacacctacgccacggccaggacgccgggacggggaggacgaggcgggatgccgtgattt

SEQ ID NO: 1613 - DNA, 1571 bp, Sorghum bicolor
atgggagaactccaggagcggaagccgcctgcgtcgtgtacagccgcgcggccacgcgtgctgctcctgtgcagcccgtgcatgggtcacctcatccccttcgccgagctcgcgcgccgcctcgtggccgaccacggcctcgccgccacgctcctcttcgcctcggctacatccgcgccctcggagcagtatctcgccctggccgccgccgttcccgacgccgtcgacctcgtcgctctgccggcaccgccgccagttgctgcgctgcctccctccgtgcccacgcgcgagcgcgtccaactcgccgtcgtctccaacgtgccacgcgtccgggagatcgcgcgggagctcggcgcggccgcgccgctcgtcgcgctcgtggtggacatggtcgccgtggtggcgcgcgacgtcgcggaggagctgggcgtcccgttctacacgttcttcacgtccccgtggatgacgctttccctgttcctccacctccccgagatcgacgccgcttgcgccggggagcaccgggacgccacggagccgatccgcctccccggctgcgtgccgatccatgctcacgacctgccgacgtccatgctcgccgaccggagcagcgacacgtacgccgggttcttgtccatggccaaggatgccgcaagagtcgacggcattcttgtgaacacgttccatgaacttgagcccgcggtgggcgacggtctgcagctgcagctgcctgtccacccgattgggccattggtttggacaagaccggtcggcgtggacaatgaccacaagtgcatgagctggctggaccagcagccacgtggctctgtggtgtatgtgtcatttggcagtggtggcacgctgacatggcagcagacggctgagctggcgcttgggctggagcttagtcagtgtagattcatttgggttgtcaagaggccacaccaaagttcaacagttggagcattctttggcactcaaaaagatgatgatgagcacattcccttggattttttacctgaggggttcatggagaggactagagggatggggttagtgacccaatcttgggcgccacaaacagctatacttggccatccttccattgggtgcttcgtcacgcattgcgggtggaactcagtgctcgagagtgtaatgaatggtgttcctatggttgcttggccactttacgctgagcaaaacatgaatgcggcgatgatggatgtccaaattggtgtggccgtccaggccaaggttggagttgatcgatttataaggaaggaggaagttgcgaattctattcagcgtgtgatgataggggacgaagctgaaagattgaggaagcgatcaagtgagctcagaggccaatcagcgcatgctttgagcaaggatggttgttctactcgtgttctggcacaaattgcaaacacatggaaatgcgctagtaggaaatgaagaaactctgagcagattatattgtaaggacaccatgagttccaaaggcagcaaagagaacaagattacaagactcgacatatttagcagcacaatattttcaatagactatttat

SEQ ID NO: 1614 - DNA, 1414 bp, Sorghum bicolor
gcatcaattgaagaaaaaaaaaagaatcaaaatcaattgctttgcgtgcggcatcgatttagtcggaacccaaatcgagggtttcgcaagcgagatcgtcgccggtgacagggacgagatggacgccggcgggggcggcgtcttggccgccgtactctgcatgctgctggtcttcgctatcttccccctcctcctctggcgccgccgctccgatgccgccaccgccgataaccaccgccacccgccccagcccctccaggaggatcaagtgctgcacggccgcgcggcggcgcgacggatgcgtcggaggcctggggctgccggagcaggctcctctgccgcgtcaactagccgcaatgttgtagaggacgacgcggagagtgatgaggaggaggtccccgaaggtcgcaacgtccccagatcctccaaaaaggagaagaaaaggcaagagcgagaggcgcagcgtcaggctgaagaagctgcacgggattcaaggaggagtaaacaagaccgatacgatgagatgaggaggaagaaggatgaggaacgtgaggcacaagagaggcaattggaagaagaagctagggcacggaaaacaaaggaagaggaggctgctgctttagagtttgagaaatggaaaggggccttttctgttgatgctgaaggtacaacagagagtgagacacaagacgatggtcagggtttgctccacaactttgtggaatacataaagaagcagaagtgtgttcccctagaggacctggctgcagagtttaggatgcgaacccaggactgcatcaaccgaattgttactctggaaagcatggataggttatctggtgtgatggacgaccgtgggaagttcatctacatctccactgaagagatgaaggcagttgcagagtacatcaggaaacaagggagagtgagcatatcacatctggccaacaactcaaaccagtttatcgatttggagcccaaggcccagtacgaggaagagaggcagcaagatgacagtgcagcagcgggcacagaaccatgagaattccttggcctggcaccagcaccatgtagcatactcttgtgtttctgcgctcagggatgtctgacttcttaagttgcgctaacatggttctaagttggacactggccatatatgtagtggtataatgtacttgtgctgacatgctaaataccatcataccatgtagaacagagaacttgagggtttgaatttgagagcggatactgaatgagagatttattggaagcctccggtactgggtctgccctgcccatctggatctaatggtttcaagcgctagtatgaaaagaaaaaaccgaacttcgatactctgctccttgcattcatgtgttttgagacaggagacaaacaattcatttcattaggtaa

SEQ ID NO: 1615 - DNA, 1305 bp, Saccharum officinarum
aaagaatcaaaatcaattgctttgcgtgcctcgatttggtcggaacccaaatcgagggtttggcaagcgagatcgtcgccggtgacggggacgagatggacgccggcgggggtggcgtcttggccgccgtgctctgcatgctgctagtcttcgccatcttccccctcctcctctggcgccgccgctccgatgccgccaccgccgataaccaccgcgccccgccccagccccttcaggaggatcaggtgctgcacggtcgcgcggcggcgcgacggatgcgtcggaggcctggggctgccggagcaggctcctctgccgcgtcaaccagtcgcaatgttgtagaggacgacgcggagagtgatgaggaggaggtccccgaaggtcgcaacgtccccagatcctccaaaaaggagaagaagaggcaagagcgagaggcacagcgtcaggctgaagaagctgcacgggattcaaggaggagtaaacaagaccgatatgacgagatgaggaggaagaaggatgaggagcgtgaggcacaagagagacagttggaagaagaagctagggcacggaaagcaaaggaagaggaggctgctgctttagagtttgagaaatggaaaggggccttttctgttgatgctgaaggtacaacagagagtgagacacaagacgatggtcagggtttgctccacaactttgtggaatacatcaagaagcagaagtgtgttcccctagaggacctggctgcagagttcaggatgcgaacccaggactgcatcaaccgaattgttactctggaaagcatggataggttatctggtgtgatggatgatcgtgggaagttcatctacatctccactgaagagatgaaggcagttgcagagtacatcaggaaacaagggagagtcagcatatcacatctggccaacaactcaaaccagtttatcgatttggagccgaaggcccagtacgaggagagccagcaagatgacagtgcagcagcaggcacagatccatgagaattccttggcctggcagcatgtagcatactcttgtgtttctgcgctcagggatgttctgtagtgacttcttaagttgcgctaacatagttcgagttgcacactggccatatatgtagtggtataatatacttgtgctgacatgctaaataccatcataccatgtaaaacagagaacttgagggtttgaatttgagagcggactaccgaagagagatttattgcaatccatctggatctgatgttttcaagcgctagtatgaaggaaaaaaatcgaactttgatgctc

SEQ ID NO: 1616 - DNA, 1228 bp, Panicum virgatum
atcaaatcgagggtttgggtagggagatcgccggtgaccgggaagatggacgccggcgggggcggcgtcttgggcgccgtgctctgcatgctccttgtcttcgctatctttcccctcctcctctggcgccgccgctccgatgccgccgcctccgcctccgccgacaaccaccgcctcccgccccagccgctccaggaggaccaggtgctgcacggtcgcgctgcgccgcgccgcatgcgtcggaggccgggagcagcctcttcttctgctgcatcaaccagccgcgatgttccagaggaagatgaggagggtgacgatgaggaggtccaggacgttcccagatcctccaagaagaaggagaagaaaaggcaagagcgagaggcgcagcgtcaggctgaagatgctgcacgggattcaaggaggaataaacaagaccggtatgaggaaatgaggaggaggaaggatgaggagcgtgaggcacaagagagactactggaagaagaagctagagcaaggaaagcaaaggaagaggaggccgctgctctagaatttgagaaatggaaaggggccttctctgttgatgctgaaggtacaacagagagtgagactcaagatgatggtcagggtttgctccacaactttgtggaatacatcaagaagcagaagtgtgttccccttgaggacctggcagcagagttcaggatgcgaacccaggattgcatcaaccgcattgtgactctggaaagcatggataggttatctggtgtgatggatgaccgtgggaagttcatctacatatccaccgaggagatgaaggctgttgcagagtacatcaggaaacaggggagagtgagcatatcgcatctggcgaacaactcaaaccaatttatcgatttggagccaaaggctcagtacgaggaggagagccatcaagatgacagtgctgcagtggacacggatcaatgaggaggtcgttggcgttggcaggcacacactcttgtttctgtgctcagagatgtttgtagtgatttcaaagctgcgataacatacatgggttgccttggatgattgagaggtgtagtaagcaagtcactggtagcatatactactagtatgatacatgtggacatgctaaatatcatcatatcatgtagaagagagaagctgtaggtttgaattggagtgggccagagatttcatcaagtagtatgaaaatcgagcttgggta

SEQ ID NO: 1617 - DNA, 2255 bp, Brachypodium distachyon
gtagaccgccccggaatttcacgcgcaccctcccactccacactctcctcccaaaaatttcccccccctaaaaccctagcttagctccccccgcgcgcccatggcctccgacgccaagcccgactccccgcccgccggcgtcgaccccccgccgcccaaggaggaggcgaaggcggagaaggagggggagggggaggagccgcagtcgggggggcggaagcgcgggcggcggaagaagggggaggcggagaaggagaaggagaagcccccgcccgccacccccaccatcgagaggccctccagggagaggaagaccgtcgagcgctactccgagctcgccccccgcgtcacccccgccaagaagtcccccgccattctccagggctctggatcgaagctgaaggacattcccaacattcaattcaaactatcaaaaagaaaggcagacgagaacctgcaaagtcttcatgttttaatgtatggaagaaaatcaaatgtccattacttgaagaggaacatagctcaattttctggttttgtttggactgacaatcaggaaaaacaaaggaccaggataaaggaaaagcttgacaaatttaacaaggagaagttgctggatttttgtgaaatccttgatatacatgtttccagagcagccacaaagaaggaggaagtctctgccaaattactggaatttttggagtccccttgcatcactagagatgttgttctcactgatgataagaaagggaagaaacgtggaaggagatctaaaggaaatggccaggcgactgctgaaggcgcttctgatgggaagaaaaggagaaagagtcgaaagcaatcaactgaagctgctaaagagaatgacgatgaagacgatgagggtcctgctgattctgaggatgcatcaatgggtgaggaagatgatgaggattctgaagcaaaagataatgctgggagtgatgaagaacctgatgagcctccagcaaagaaaaaggcaacagatgataaacaaacaaaaaaggcaaaagaaaaggatgcgactgccaagaaggcttctacaagacctgcaaaaggtgtgtctaagccttctcaagacactgaagaagatgatgagccagaagttgagttagaaagcaaaaaggttgtcaaaaaagtctcaaagagttcaaaggagagtgatgttactgtagataaaaccaccaagaaggcttctaaatccaaaaaggatgaaggaaaagatggccagaacaataattctggtgcattgaacaataaggcacgcaagaaggatgctgccaagacaaccaataaaaataaaggaaaaggaaaaggcagcacagaggctggggcagccccaaccactgaagagctgcatgctgttgttagtgacatattgaaggaagttgacttcaatacggcgacattggcagatattcttcggcaattaggtactcattttaagatggacctcatggataggaaatcagaggtgaaacacattattgaggaagtaataaatagtatgtctgatgatgaggaaggtgaggaagacaatgctgaagatgacaaagacaaaaatgctaaggaggaaaattcaaaggaagatgctgatggtgacgagaagtaattcagcggaccacatgtgatggtcgcttgtgttagtgttatggatgcaggactttctagcccaacattgccgtttgggctgtgttgggtctgtacaatgagggcaccgcaacaatgaactggtgacctgggggtagtacaaggttgttaacaatttgatagccacacacacctagttgttgtgcttgactttggtgtgacttgtagtctagttgctggtcatgtacaatagctgtgctgttataactttgcttaggtagctagcctgactgtaatatgcagaataattctttgcctgttccttccatttatccatgtaaaacagtgaatttggaatttttggttcttgtgtcaactctcatctgcccaccttgccaggatgttcaggaggatttgttgaggaaatgatatcggtcatttcaggaaccaacatgggctctggagcaaaggggcatctgtatcgaggtgctgtgctgcagtttatggttccgaattaataagtgccatctgtgagtatgagctgattttatgtggtaaaatctcttaattgcaatgtgatccagtgattaatatggaatgccatatgttattgttgatggtgaagtaaaatctgctcctttccctga

SEQ ID NO: 1618 - DNA, 1292 bp, Oryza sativa
acacgcagtcggcgccgcgatgataaaaggcgagagaaatttacccacgagtcgctcgcgcggtgactgacacaccgtggcgatgacacacgccgaaaggaaagcttggccgcggcgcgggggcattttcgggaggagacacgaccacgaccccacgaggggatcgaaaagttgcggagcttttatttaaccggccggtttgtgccactctcgccactgtcctaacctgcacttcgctctctactcctctcgctctcggtcatgggtggtggtgcggcggcgagcagggtgtcgtcggccatggccgtggcggtggcggcggcggcggcgttggtggtgatgtgggcggggacggcgacggcggcggcggccgtgtacgaggtgggcgacaagaccgggtggaccatcatgggcagccccaactacacagcctgggccgcctccaagaagttccatctcggcgacaccgtcgtttgggaactaaactcggcctactttaacgcgcccacagtccggctggactgcagatcagtactccgtgtagagcagatcggcccattgtcgaatcctactcaggaattgtcgaattatactcagccgaaaaagagccgtgcagtcttcacgtacaacaagcagttccacaacgtgatggcggtgagcaagtcggactacaagaactgcgacacgagcaagccgatcgccacctggtcgacgggcaacgactcggtggtcctcaacgccacgggccaccactacttcctctgcggcttcccgggccactgcggcatcggccagaaggtggacatccgcgtcgccgcctccggccactcctctgctgccccttccatggcgcccgccccggcctccggctccgaggcacccgtcgcccccggcggcggcggcggcggctcgtccggccacgccgccgccgccgccccgtcgccgcacggcaacgccgccgttggccgctccgtcttcacggccatcgccgtgtccgtgctctccgtcgccgccgctggcctgaagttgatctagttggggggttggggggggggggtggggttaggatggcgcgcgccctgtgaattgtgagcttttgcgtttggagctgtgttcatcttctcttttgcccccctcctttcgtgtcgtaattaattaaactagtatgatcctgtggaattgctgcaatttgaggatctctgccggttgtcacctcatgttttggactttggaattgtgggtttcatctcagattagatcaatcgattgaacaatcgtatgctgctacaaca

SEQ ID NO: 1619 - DNA, 1934 bp, Malus domestica
acatatctaccccttccaactccaatcaaccacccccggacgaacagaagcagcaatggctttccagaagatcaaggttgccaaccccatcgtcgagatggacggagacgaaatgacaagagttttctggaaatccattaaagacaagcttattttaccatttgtggaattggacatcaagtactttgaccttggccttcctcatcgtgatgccactgatgacaaggttactgttgaaagtgctgaggctactctcaagtataatgtagcaatcaagtgtgcgactattactccagatgaagctcgtatgaaggagtttagcttgaagagtatgtggaggagtcccaacgggactattaggaatattttgaatggtactgttttcagagaaccaattctttgcaaaaacatccctcgccttatcccaggctggacaaagccaatatgcattggaagacatgcttttggtgatcagtatcgagcaactgatgcagtcattaaaggaccggggaaactgaaattggtgtttgtgccagaaggaaaggatgagaagacagagctagacgtgtacgactttacaggggaggggggagtagcattggccatgtacaacaccgatgagtccatccgtgcttttgcagaggcttccatgaccactgcttatgagaaaaagtggcctctttatcttagcacaaaaaatactattctgaagaagtatgatggaagattcaaggacatatttcaagaagtttatgaagctaactggaaatcaaagtttgatgctgctggcatatggtatgagcatcgtctcattgatgatatggtggcttatgcacttaaaagtgatggtgcgtatgtttgggcatgcaagaattatgatggagatgtgcaaagtgatatgttagctcaagggtttggatctcttggattgatgacatccgtactggtgtgcccagatggaaagactattgaagctgaagctgcacacggtacagttactcggcattacagggttcaccagaagggaggtgaaacaagtacaaacagcattgcttccatctttgcttggacaagagggcttgcacacagggctaagttggatgacaatgcaagacttttggaattcactcaaaaactcgaagaagcttgtattggaactgtggaatcagggaaaatgaccaaggatcttgcactaattcttcacggatccaagctggctaggaaccactacttgaacactgaagagttcattgatgctgtggccgaggaactgaaagctaagcttgcttgctaggaagcactgcatttttcagacttgcattggaggcacaggcaactgtacttctgtattttgaaagaaataatggagggcggaaaaaggggaaggcagggaggtggaaaagggaagacgagcggtggaaactttcccttctggtgttattttacactcatctgtttcttgagtgtattagtttcttgtgcactatttggattctcgactcttacccatttgcatgttcttacctccacatcagttgctaagcttcggcaatttttacttttttcatagttaactgcggaataatctttctttggttcatctttggacagacagtgcctgaagtccgtaaaccggacagttcgagtccggttaatgttcttcgttcctgggttctatctcgagtcttgatataagtatttgaacaaacactggcaaatgcatttcaaaaaataatggccaatggttcgtacccattgatctctgtccgccaaggatatgtcgataacttgacatatgcttgaccagtacgtttgtatggatgatcacagtgaggcacatcttggctgatatgccgggtgatgtaaaacccggttgatatgctgaaaccgtctcctgactgatacgccggatgtcgtaaatatagcatcaataa

SEQ ID NO: 1620 - DNA, 1723 bp, Malus domestica
atacttaatattttgcctgcctctcactgttaaagagtcgccgattccattcccttcctacctacacatctacccttccaattccaagcaatcactctcggacgaacacaagcaccaatggctttccaaaagatcaaggtcgccaaccccatcgtcgagatggacggggacgaaatgacgagggttttctggaaatccatcaaggacaagcttattttgccatttgtggaattggacatcaaatactttgaccttggtcttcctcatcgggatgccactgatgacaaggttactgttgaaagtgctgaggctactctcaagtacaatgtagcgatcaagtgtgcaactattactccagatgaagctcgtatgaaggagtttaacttgaagagcatgtggaggagtcccaatgggactattaggaatattttgaatggtactgttttcagagaaccaattatttgcaaaaatatccctcgccttatcccaggctggacaaagccgatatgcattggaagacatgcttttggtgatcagtatcgagcaactgatgcagtcattaaaggacctgggaaactgaaattggtgtttgtgcccgaaggaaaggatgagaagacagagctagaggtttacaactttacaggggaggggggagttgcattggccatgtataacactgatgagtccatccgtgcttttgcagaggcttcaatgaccacagcttttgagaaaaagtggcctctttatcttagcacaaaaaatactattctgaagaagtatgatggaagattcaaggacatatttcaagaagtttatgaagctaactggaaatcaaagtttgaagctgcaggcatatggtatgagcatcgtctcattgatgatatggtggcttatgcacttaaaagtgatggtgggtatgtttgggcatgcaagaattatgatggagatgtgcaaagtgatatgttagctcaagggtttggatctcttggattgatgacatcagtactggtgtgcccagatggaaagactatagaagctgaagctgcccacggtacagtcactcggcattacagggttcaccagaagggaggtgaaacgagtacaaatagcatagcttctatctttgcttggacaagaggcctagcacatagggcgaagttggatgacaatccaagacttttggagttcactcaaaaactcgaggaagcttgtattggaactgtggaatcggggaaaatgaccaaggatcttgccctaattcttcacggatccaagctggctaggaaccactacttgaacactgaagaattcattgatgctgtggccgaggaactgaaagctaagcttgcttgctaggaacgactgcagttttcagacttgctttggagggataggcaactgtggacttttgtattttgaaataaggcaggagggcggaaaaaagggaaggctccgaagagcggaaaaaagggaaggcaggaagggtagaaaaggcgaagacatgggtggcggaaacttccccttctggtgttatgttagcgttgttgactcgtctgtttcttgtgcaccatttggattctcgactcttattgatttgcttcttctttcctcctcgtcggttgctagctttggcaattttccttcttcatgactcgcctcaaattttatgactcctctctttatagaacattttaatttcatacgccaatgcatttaaaaaaaa

SEQ ID NO: 1621 - DNA, 1638 bp, Aquilegia formosa
tctcctccaaagattcccattttccacgcgcacctctttctctctctctctctctcgctctcgctctcttttcatctgaatcaatcgaatcagacagactaatatggcttttgaaaagatcaaggtcgctaatcccatcgttgagatggatggggatgaaatgactagaattttctggaaatcaatcaaggataagcttatattcccctttttggatttggatattaagtactttgaccttggtctccctcaccgtgatgccactgatgacaaagtcacagttgaaagtgcagaagctacattgaagtataatgtagcaatcaagtgcgcaactataactccagatgaagcacgcatggaggaatttaagctgaagagtatgtggagaagtccaaatggaacaatcaggaatattttaaatggtaccgtgtttagagaaccaattatctgcaaaaatgttcctcgacttgtcccaggctggaccaaggccatatgcattggaaggcatgcttttggtgatcaataccgagctactgatttggttgtcagaggagctggcaaactcaagatggtgtttgtacctgaaggacaaaatgaaggtacggaattggaggtttacaattttactggtgctggaggagtaggtttagcaatgtataacactgatgagtccatccgctcttttgctgaggcttcaatggccaccgcatatgagaagaagtggccactctatcttagcacaaagaatacaattcttaagaaatatgatggaaggttcaaggacatatttcaagaggtctatgaagctcaatggaaatccaagtatgaggctgcaggaatatggtatgaacaccggcttattgatgatatggttgcctatgctcttaagagtgaagggggctatgtgtgggcatgcaagaactatgatggagatgtgcagagtgatttcttagcacaaggattcgggtctcttgggttgatgacttcagttctggtgtgtccagatggcaagaccattgaagctgaagcagcccatggaacggtaacacgtcattatcgagttcatcagaaaggaggtgaaacaagtacaaatagcattgcttcaatctttgcctggtcacgagggctttcacaccgggcaaagttggatgacaatcctagattgttagacttcactgaaaaattggaagcagcttgtgttggtactgtagaatctggaaagatgaccaaggatcttgcacttctcatccatggatccaaggtcagcagggaccagtatctgaacactgaggaattcattgatgctgtagctgaggagctaaaaacaagactctcaaccaaagcgaagctgtctcactagggtggagaggatattttggtcactgtcagaacctagacataataaggaagagaggtctgcgtgtgttgtgtgttggagcccatttcatgttttttagtaagagttggttgcgctagagtcttgctgagctttaattgcaaacaattgtcctcatttgaggttatttgaacatctatcttgagcaatgaaatcacaaaatgtcagttgctcgttgtgaactaaattgactttgtcacattggaattgatgattagaattttagcgaaatcgatatacta

SEQ ID NO: 1622 - DNA, 3857 bp, arabidopsis lyrata
attcaatttcactcgtcgatcataacctctgcgggcgaagatggaattcgagaagatcaaggtgatcaatcccgttgttgaaatggatggagacgaaatgactcgagttatctggaaattcatcaaagacaagcttattttccctttcctcgagttggatatcaaatactttgatcttggactgcctaaccgcgatctcactgatgataaggttactatagagagtgctgaagctactttaaagtataacgtggctattaagtgtgcgacgattactccagatgaagctcgtgttaaggagttcggcttaaagaaaatgtggaggagtcctaatggaactataaggaacattttaaacggcacagttttcagggaacctatcatttgcagaaacatccctcgtattgttccaggatggacgaagccaatctgtattggaaggcatgcttttggtgatcagtatagagccactgatatcattgtcaatgaaccaggaaaactgaaactagtttttgagccaagtggatcttctcagaaaacagaatttgaagtcttcaatttcactggtggaggtgttgctttagccatgtataacactgatgagtctattcgtgcatttgctgagtcctcgatgtacacagcttaccagaaaaagtggccactttacctctccacaaaaaacaccatcctgaaaacatatgatggaagattcaaggatatattccaagaagtttatgaagctaattggagatccaagtatgaagctgcagggatatggtatgagcatcgtttgatagatgatatggttgcatatgccatgaaaagtgagggcggttatgtctgggcatgcaagaattacgatggagatgtacagagcgatttcttagcccaaggatatggatctctgggaatgatgacgtcggtgttggtttgtcctgatggaaaaaccattgaagcagaagcagctcatggcacagttactcgccactacagagttcaccaaaaaggtggtgaaacaagcaccaacagcatagcctccatttttgcttggtccagaggccttgcccacagggcaaagctggacagcaatgccgcactcttgagctatactgagaaactagaagcagcttgcatggggacggtggagtctggcaaaatgaccaaggatctagctcttctgatccacggacccaaggttaggagggatcagtatgtgaatacagaagagttcattgatgcggtggcatgggagttaagaagaagattgttaggcaactccaggttgtgagaagaagaatggaaatctgaaaagcaaagagtcgcagcagcgcgatgtcagtatcacttgtagtaacataacatatgtgtagaacttaagcctagaaaaggggcaattgcataaataaaaggggaactcagatttcccaaagccgagacgactcactcctcattcaaacgttcaaatttgaatctttctttctctgtataatctctgttgtaaaagctaccaaccaagcaacagaaatggctacgttcactttgtcattatgttatctttccctttgtattatttatctggcaaagaaatgaatggttgagctttagttataagtgttccctcttgctccctcaagttgctatggctatgtgggattagtaagaagacgacggaggatgattttgatgataacagctcccgtttgtcctcctcaccttctcctacgccattcttcttcgcttcgccatgaatcaatcggaaactttcatcggaagaaaactccacgtgtcagaaccgtatcctcttcttctttgttgccgcaaccgtctgttcgtccggataaggcatcggagttgaagactctgtggaagaaattctacaaagtcgcgtcgccttattggttttccgaggacaaagaccaagccaggcttcgtctcgccgccgtcttcgccctaactctcgccaccactggcattagcgtcggcttcaatttcctcggccgtgatttctacaattctctcgccaacaaagaccaagagcaattcacgaagcagttgttttattacctctgtgctttcgccggcggaattccgttctttgtgctaagagattatacaaaagagactttatcactgagatggagatcatggatgaccaaatattacctgcagcgctatctgaaagatcaaaccttttacaagatccagtctcagtctatgattgacaatccagatcagcgcattgttgacgatttgagttccttcactggaactgccttgtctttctctttgacgcttgtcaatgccaccattgacctcatctcttttagcaacatcctcttcaccatttatcctcctctctttctcgttctcttgctctactcctttggcggaacagccatcagtgtctttcttggcaagggactagtcaatctcaactttctacaagagaagaaagaggctgactttcgttacagccttgtacgagtgagggaaaatgctgaatcgatagctttctatggaggcgaacagaatgaaatgcagcttctgcttcagcgtttcagaagcgcttttgataatttaactgaattgctgatagcatccagaaacctagaattcttcaccgacggatatcgctacctcattcagattcttccagttgctgttgttgccccaatgtatttctccgggaagattgagtttggtgtcattaaccagtcagtatcagcattcaatcatatcctaggagacttctcgctcgtcgtttatcagtttcaagctatcagctctttttctgctgtcattgatcgactaggtgaatttgatgatcttttggataacagcatcttcagagatccctctggcactgcggacgagattgagctaacgtatcagagtgagatgaactcttcactgctggacaccaatggttcaatcaagtcccaactgaaccaaaagcgtctggagatcgaggagcttactcttcaaacaccaacaaatggaaccacattggttcacaacttatctgtggatatatatgacaaggatcatctactgataatgggtcctagtgggagcggtaaaacttcgctgctaagagcaatggctggtctttggaggtcagggaaaggaaaaatcacgttctacctcgattctgaggatgatcttacacaggaggcatctaatactcaggaaaattcagagaaaagaagttcgggagacgtattgttccttccacaaaggccttatatggttctgggatcgttgcgtcagcaattgctttatcctacctggagtgcaactgtggaggaggcgacacctggtggcagtaatatagacggttcaccacctctcctgatcagagacgacggaaatgaaaagtgtaataagccgacaacagatgatctgatgcggactctagagaaggtttgtcttggacatatagcggatcgctttggtggtcttgattcgatacacgagtggtccagtgttctttcacttggtgagcagcagcgcctcgcctttgcacggttattgctttctcagccaaagctggcgctcctggatgaatccaccagtgcgttggatgaagctaatgaggcgctcctgtaccagcaaatccagtcggctggcattacatatataagcattggccaccgccgaactttaaagaaattccataacaagatcttacaaatctcaacggcagacccgaagagcaaggaaagtaactggcgaatagaggacgtggatgcccaagattgtttgtatggtcgattgaatcaagaggaggtgccaagtgaaagctgattgattacatagagacagaagaagaaagtaaatctgcaacgggtgtcatg

SEQ ID NO: 1623 - DNA, 1778 bp, arabidopsis lyrata
agggaccaaaatcgaacaaataataataacggggtcaaaataacatcatcgaaattttaaatagcataaatacaacctctccaaacctgcccacaagttttttcacctacttcacatcactcaccaccagctcctcctacgacgatcttcttctccggcgtgatcttctctcgttttcagatctccgacgatcggaatatcaaatctgatcgattaattccgtcaatcatacaaaaaccgaaagcaaatacaccatggcgtttgagaagatcaaggtggcaaatcccatcgtcgagatggatggtgatgaaatgactagggttatctggaagtctatcaaggataagcttattacgccttttgtggagttggatattaagtactttgatcttggtcttcctcaccgtgatgctacggatgacaaagttactgttgaaagtgctgaagccactaagaagtacaatgtggcgatcaagtgtgccaccatcactccagatgaaggccgtgtcacggaatttggcttgaagcagatgtggagaagtccaaatgggaccatcaggaatatcctgaacggaactgtatttagagaaccaattatctgcaaaaatgttccaaagcttgtcccaggctggacaaagccgatttgcattggaaggcatgcttttggtgatcagtatcgtgccactgatgctgtaattaagggaccaggaaaactgaccatgacctttgagggaaaggatgggaaaactgaaaccgaagtctttacatttactggtgaaggtggtgtttctatggcaatgtacaacactgatgagtccatccgtgcttttgctgacgcatcgatgaacactgcttatgagaaaagtggcactttatcttagcacaaagaataccattcttaagaaatacgatggcagattcaaagacatcttccaagaagtctatgaagccagctggaagtcaaagtatgaggctgctggaatctggtatgaacaccgtctcattgatgatatggtggcctacgctcttaagagtgagggaggctatgtgtgggcatgcaaaaactatgatggtgatgtccaaagtgatttcttggcacaaggattcgggtcacttggattgatgacatctgttctggtctgcccagatggaaagacgattgaagctgaagccgcccatggaactgtcacccgtcacttcagggttcatcagaaaggtggtgaaaccagcacaaacagcatagcctccatttttgcttggactcgtggacttgcacacagggccaagttagatgacaacgcaaaactcttggatttcactgaaaagctcgaagccgcttgtgttgggacagtggagtcagggaaaatgaccaaagatcttgcactcatcattcacggctcaaagctttcgagggacacttacctgaacacagaggagttcatcgatgctgtcgctgctgagctcaaagcaagactccaagcttaagaaactgaagaaatttggtaaatttcgaacgtctcagtctcttatctggttggtggggttggttgggttggttgggattgggaggaataaaaaatgaaactttggtggagaggagtgttgagaacgatttgtttcctctcttataatattttcaaaatattgcgacattttttcatttttattcagatctcgaattttatgtttgattgattggttatcacatcctttttttttttctttatctattcatgaaattaatattagggtcttttaggttaaaaatccacgtaggt

SEQ ID NO: 1624 - DNA, 3999 bp, Arabidopsis thaliana
ctattcaatttcactcgtcgatcattaccaacctctgcgggcaaagatggaattcgagaagatcaaggtgatcaatcccgttgttgaaatggatggagacgaaatgactcgagttatctggaaattcatcaaagacaagcttattttccctttcctggagctggatatcaaatactttgatcttggactgcctaaccgcgatttcactgatgataaggttactatagagactgctgaagctactttaaagtataatgtggctattaagtgtgcgacgattactccggatgaagctcgtgttagggagttcggcttaaagaaaatgtggaggagtcctaatggaactataaggaacattttaaacggcacagttttcagggaacctatcatttgcagaaacatccctcgtcttgttccaggatggacgaagccaatctgtattggaaggcatgcttttggtgatcagtatagagccactgatctcattgtcaatgaaccaggaaaactgaaactagtttttgagccaagtggatcttctcagaaaacagaattcgaagtcttcaatttcaccggtggaggtgttgctttagccatgtataacactgatgagtctattcgtgcatttgctgagtcctcgatgtacacagcttaccagaaaaagtggccactttacctctccacaaaaaacaccatcctcaaaatatatgatggaagattcaaggatatattccaagaagtttatgaagctaactggagatccaagtatgaagcagcagggatatggtatgagcatcgtttgatagatgatatggttgcatatgccatgaaaagtgaagggggttacgtctgggcatgcaagaattacgatggagatgtacagagcgatttcttagcccaaggatatggatctctgggaatgatgacttcggtgttggtttgtccagatggaaagaccattgaagcagaagcagctcatggcacagttacacgccactacagagttcaccagaaaggtggtgaaacaagcaccaacagcatagcctctatttttgcttggtccagaggccttgcccacagggcaaagctggacagcaatgccgcactcttgagctatactgagaaactagaagcagcttgcatggggacggtggagtctggcaaaatgaccaaggatctagctcttctgatccacggagccaaggttaggagggatcagtatgtgaatacggaagagttcattgatgcggtggcatgggagttaaaaagaagattgttaggcaacaactccaggttgtgagaagaaagaatggaaatctgaaaagcaaagagtctcagcagcgtgatgtttgatttgatgctctttcataggtgtagaacttaaagcctgaaaaggggctattgcatgaataaaaggagatagactaattgggtaatttattgaggaactcagatttcccaaagccgagactcactcctcattgattcgttaaaaattgaatctttttagcccttctttctctgtataatctctgttgtaaaagctaccaatcaacagaaatggctacgttctcgttgtcattatcttctctttccctttgtattatttatctggcaaagaaatgaatggttgagctttagttataagtgttccctcttgctccctcaagttgctatggctatgtgggattagtaagaagacgacggaggatgattttgatgataacagctcccgtttgtcctcctcaccttctcctacgccattcttctttgcttcgccatgaatcatcgatcggaaactttcatcggaagaaaaatccacgtttcagaaccgtatcatgttcttctttgttgccgcaaccgtcggttcgtccggataaggcatcggagttgaagactctgtggaagaaattctacaaagtcgcgtcgccttattggttttccgaggacaaagaccaagccaggcttcgtctcgccgccgtcttcgcccttactctcgccaccaccggcattagcgtcggcttcaatttcctcggccgtgatttctacaattctctcgccaacaaagaccaagagcaattcaccaagcagttgttctattacctctgtgctttcgccggcggcattccgttctttgtgctacgagattatacaaaagagactttatcactgagatggagatcatggatgaccaaatattacctgcagcgctatctcaaagatcaaaccttttacaagatccagtctcagtctatcatcgacaatcctgatcagcgccttgttgacgatttgagttccttcactggaactgccttgtctttctctttgacgcttgttaatgccaccattgatctcatctcttttagcaacatcctcttcaccatttatcctcctctctttctcgttctcttgctctactcctttggcggtacagccatcagtgtctttcttggcaagggactagtgaatctcaactttctacaagagaagaaagaggctgactttcgttacagccttgtacgagtgagggaaaatgctgaatctattgctttctatggaggcgaacagaatgaaatgcagcttctgcttcagcgtttcagaagcgcttttgataatttaactgaattgctgatagcatctagaaacctagaattcttcaccgatggatatcgctacctcattcagattcttccagttgctgttgttgccccaatgtatttctccgggaagattgagtttggtgtcattaaccagtcagtgtctgcattcaatcatatcctaggagacttctcgctcgttgtctatcagtttcaagctatcagctctttttctgctgtcattgatcgactaggtgaatttgatgatcttttggataacaacatcttcagagatccatctgacactgtggacgagattgagctgacatatcagagtgagatgaactcttcactgctggacaccaatggttcaatcaagtcccaaccgaaccaaaagcgtctggagatcgaggagcttactcttcagacaccaacaaacggaaccacattggttcacaacttatctgcagatgtatatgacaaggatcacctactgataatgggtcctagtgggagtggaaaaacttcgctgctaagagcaatggctggtctttggaggtcagggaaaggaaaaatcacgttctacctcgatcctgaggtagattttacacaggagaaatctgatactcaggaaaattcagggaaaagaggagacgtattgttccttccacaaaggccttatatggttctgggatctttgcgtcagcaattgctttatcctacctggagtgcaactgtggaggagacgacacctggtggcagtaatattgacggttcaccacctctgctgattagagaggacggaaatgaaaagccgacaacagatgatctgatgcggactctagagaaggtttgtcttggacatatagcggatcgctttggtggtcttgattcgatacacgagtggtccagtgttctctcacttggtgagcagcagcgccttgcctttgcacggttattgctgtctcagccaaagctggcgctcctggatgaatccaccagtgcgttggatgaagctaatgaggcgttcctgtaccagcaaatccagtcggctggcattacatatataagcattggccaccgccggactttaacgaaattccataacaagatcttacaaatctcaacggcagacccgaagagcaatgaacgtaactggcgaatagaggacgtggatgcccaagattctttgtacggtagattgaatcaaaaggaggtgccaagtgaaagctgatcaaaacctgattgattacataagagacagaagcagcaggtaaatctgcaaacgggtgtcatgaaacatataagaaacatgtttggtgtccattttgtatataatctaccagacttgacgttgactgaagatgcaagtaaatagagagattgatacagatacgagtgcaac

SEQ ID NO: 1625 - DNA, 1803 bp, Arabidopsis thaliana
agggaccaaaatgatacaaatcgtaataacggggtcaaaataacataatccaaacttttaaatagcataaatacaacaactctcaagacctgtacaagctatttcacctacttcatcactcatcaccagcttcgcatcttcttctccggcttgatcttctctcgtttctagatctccgacgatcggaatatcaaatccgatcgattaattctgtcaatcacacaaaaaccgaaaaccaaaaaaaaaccatggcgtttgagaagatcaaggtggcaaatcccatcgtcgagatggatggtgatgaaatgaccagggttatttggaagtctatcaaggataagcttattactccttttgtggagttggatatcaagtacttcgaccttggtcttcctcaccgtgatgctacggatgacaaagttactattgaaagtgctgaagctactaagaagtacaatgtggcgatcaagtgtgccaccatcactccagatgaaggccgtgtcacggaatttggcttgaagcagatgtggagaagtccaaatgggaccatcaggaatatcctgaatggaactgtatttagagagccaattatctgcaaaaatgttcccaagcttgtcccaggctggacaaagcccatctgcattggaaggcatgcttttggtgatcagtaccgtgccactgatgctgtaatcaagggaccaggaaaactgactatgacctttgagggaaaagatgggaaaactgaaaccgaagtctttacatttactggtgaaggtggtgttgctatggcaatgtacaacactgatgagtccatccgtgcttttgctgatgcatcgatgaacactgcttatgagaaaaagtggccactttaccttagcacaaagaataccattcttaagaaatacgatggcagattcaaagacatcttccaagaagtctatgaagccagctggaagtcgaagtatgatgctgctggaatctggtatgaacaccgtctcattgatgatatggtggcctacgctcttaagagtgagggaggctatgtttgggcatgcaaaaactatgatggtgatgtccaaagtgatttcttggcacaaggattcgggtcacttggattgatgacatctgttctggtctgcccagatggaaagacgattgaagctgaagcggcccatggaactgtcacccgtcacttcagggttcatcagaaaggtggtgagaccagcacaaacagcatagcctctatttttgcttggactcgtggacttgcacacagggctaagttagatgacaacgcaaaactcttggatttcactgagaagctggaagccgcttgtgttgggacagtggagtcagggaaaatgaccaaagatcttgcactcatcattcacggctcaaagctttcgagggacacgtacctgaacacagaggagttcatcgatgcagtcgctgctgagctcaaagaaagactcaatgcttaagaaactgaagaaattgggtaaaattcgaacgtctcagttcctaagtgtcttatctggttggtggggttggttgggatcgggaggaataaacttttgtggagaggagtgttgagaacgatttgtttcctctcttataatatttccaaaatattgcgacatttttccatttttattcagatctcgaattttatgtttgattgattggttatcacatcttcttttttttggttgatcgatttatgaaattggtattagggtcttttaggttataaatacacagtacggtttaactagaatacacataccaccaagccattggttg

SEQ ID NO: 1626 - DNA, 1588 bp, Artemisia annua
  misc_feature (1585)..(1585): n is a, c, g, or t
acacacaaacacacacacgtatttgtttctctccgtcacggctcaaatctcctcctccgagtccgatcagtaaacaaaacaaaaatgggtttcgagaagatcaaagttgcaaatcccatcgtcgagatggacggagatgaaatgacccgtatcttttgggaatcaattaagaataagcttatctttcccttcttagagctcgacatcaagtattatgaccttggtcttcttaaccgtgatgccactgatgacaaggttaccgtagaaagtgctgaagctactctcaagtacaatgttgcaattaagtgtgccaccattactccagatgaggctcgtatgaaggagtttactttgaagagcatgtggaggagtccaaatgggaccatcaggaatattttgaatggtaccgtctttagggaaccaattctctgcaaaaacatccccaaactggtaccaggttggacaaagccaatatgcattggaagacatgcttttggtgatcagtacaaagctactgatgccgtgattaaaggacctggaaaactgaagatggtatttgttcccgagggagccggtgaaaccatcgatttggaggtttacaacttcactggtgctggaggggtagctttgtcaatgtacaataccgacgagtccattagagcttttgctgaggcctcaatgaacaccgcctacctgaaaaaatggccactttatcttagcacaaagaataccattctaaagaagtatgatggaaggttcaaggacatattccaagaagtttacgaatgcaactggaaatcgaagtttgaggctgctgggatatggtatgaacaccgtctcattgatgatatggttgcttatgctcttaagagcgacggaggttatgtatgggcatgcaaaaactatgacggagatgtgcaaagtgatatgttagcacaaggttttggatctcttggattaatgacatcagtactggtgtgtcctgatgggaagaccattgaagctgaagcagcccatggcacagtgactcgtcattacagggtgcaccaaaagggtggtgagactagcacaaacagcatagcctcaatctttgcttggacccgagggcttgcccacagagcaaagttggatgacaatgctaagcttttggatttcactgaaaagctagaagctgcttgtatcggtgttgttgaagccggcaagatgaccaaggatcttgcacttattattcatggatccaagctcagtagggagcactatttgaacacggaggaatttattgatgctgtagcagatgaactcaaagcaaaactgtccgcctaataatcagtgaactgtatcaacagttgaggccgggttgattgaatgaagaggaacaaacgaagaaagatcgctatcaagcaggatcccatttcatcatttttattcttattttgatttgctactatatttggtagggtctatttgccggtttagttttcaagttatcggtttccatgactgatcttgtgctgtaatctgctttcccctttattttaagttataatagaacctgctatgatctataatctatatccactttttntat

SEQ ID NO: 1627 - DNA, 1627 bp, Persea americana
  misc_feature (671)..(671): n is a, c, g, or t
  misc_feature (716)..(716): n is a, c, g, or t
tctctctcaatctctcgtctgtaacttcttccgtgccctagaaaatggctttcgagaagatcaaggtagccaatccgatcgtagagatggacggagatgaaatgactagggtgttttggaaatcaatcaaggataagcttattttcccatttttggagttggacataaagtactttgaccttggcctcccttatcgcgactctactgatgatagagttacagttgaaagtgcagaagcaactcttaagtataatgtggcaatcaaatgtgcaacaataactccagatgaagttcgtgttaaggaattcaacctgaaatccatgtggaagagtccaaatgggacaatcaggaatattttgaatgggacggttttcagagaaccaattctctgcaaaaacattcctcggcttgtcccaggatggaacaagcccatatgcattggaaggcatgcctttggtgatcaataccgagcaactgatacagttatcaagggccctggcaagcttaaattggtatttgaaggaaaagaagaacagaaagagttggaagtgtacaatttcacaggtgctggaggagtcgcattgtctatgtataacactgatgagtccatctattcttttgccgaggcttcaatgaacacagcttttgagaagaagtggccactttacctnagcacgaaaaatacgattctcaagaaatatgacggaaggttcaangacatattccaagaggtttatgaaactaaatggaagtcaaagtttgaggctgctgggatttggtatgaacaccgactcatcgatgatatggtagcttatgcacttaagagtgatggtggttatgtttgggcatgcaagaactatgatggggatgtacaaagtgatttcttagctcaaggttttggatcacttggattgatgacgtcagttctggtatgccctgatggaaaaaccattgaagctgaagcagcacatggcacggttacacgccattaccgtgttcaccagaaaggaggggaaaccagtacaaatagcattgcttcaatctttgcttggtcacggggacttgcacacagggccaagttagataacaatgccagactgctggatttcactcagaaactggaagcagcatgcatcggaaccgtggagtctgggaagatgaccaaagatcttgcacttatcatccatggatccaatctcacccgagagcattatctgaataccgaggagttcattgatgcagtggcgggggaactgaaatcaagcctatcttgctgatcataggttcaagcatgggggcacttaaaaagagtgtatttggtcatctgggttctcatttttccggtgcagttcgggaaagaaataagagaggcatctcaaatgcccagctgccatgtaggacttacgagttttaatttaaagcctattttgtttaattatatccaagagtttcttggaattatgtttttcattgttcatttttctgatttcgcttcatttatgggtcccatgctggtatctcagctggtaagcggacattaaaagtcctccactgggacactgtattgtgtacactgagggttgagccatggttggaatgccgagaatttgacattagtgccttatta

SEQ ID NO: 1628 - DNA, 1555 bp, Brassica oleracea
  misc_feature (710)..(710): n is a, c, g, or t
  misc_feature (1250)..(1250): n is a, c, g, or t
gactccactcaccaccatcgaccatctctgtctcccgccggaaccacttctctcgtttgtagatcgccgaagattagaacgtccaatccgatcgtctggatccgtatatctaacgaaaaaccatggccttcgagaagatcaaggttgcaaatcccatcgtcgagatggatggtgatgaaatgacccgagttatctggaagtccatcaaggacaagcttattacccctttcgtggagttggatatcaagtacttcgaccttggccttcctcaccgtgatgctaccgatgacaaagttactatcgaaagcgctgaagccactaagaagtataatgttgcaatcaagtgtgccaccatcactccagatgaaggccgtgtcactgaatttggcttgaagcagatgtggagaagtccaaatggaaccatcaggaatattctgaatggaactgtttttagagaaccaattatctgcaaaaatgttcccaagcttgtcccaggctggacgaagcccatctgcattggaaggcatgcttttggtgatcagtaccgtgccactgatgctgttatcaagggaccaggaaaactgactatgactttcgagggaaaggatgggaaaactgaaactgaagtgttcacatttactggtgaaggcggtgttgctatggccatgtacaacactgatgagtccatccgtgcttttgctgaggcatcnatgaacactgcttatgagaagaagtggccactttatcttagcacaaagaacaccattcttaagaaatacgatggcagattcaaagacatcttccaggaagtgtatgaagccagctggaaatcaaagtatgaagctgctggaatatggtatgagcaccgtctcattgatgatatggtggcttacgctctgaagagcgagggaggctatgtgtgggcttgcaaaaactatgatggtgatgttcaaagcgatttcctcgcacaagggttcgggtcacttggactgatgacatctgttctggtctgcccggatgggaagacgattgaagctgaagcagcacatggaaccgttacccgtcactacagggttcaccagaaaggtggcgagaccagcacaaacagcatagcctccatctttgcttggactcgtggacttgcacacagggctaagttagatgacaactcaaaactcttggagtttactgagaagctcgaagctgcttgtgtcggtacagtggagtctggaaaaatgaccaaagatctngctctcatcattcatggctcaaagctctcgagggacacttacctgaacacggaggagttcatcgatgcagttgcggatgagctcaagacaagactcggcgtcaaagcttaagacatttgggtaaaacattcggctactcagtcatatgtggtttatctggtgggtttgtgagagtggttgagattgggaggaataaaagaattcaagatattttgcttattaagaacgatttgtttcatctgcaataaatattttctaaacattgtcacatgtttccccttttatgaaaatttcgaattttaatt

SEQ ID NO: 1629 - DNA, 1591 bp, Brassica rapa
ctttttcacctactccactcaccaccatcgaccatctctgtctcccgccggaaccacttctctcgtttgcagatcgccgaagactagaacgtccaatccgatcgtctggatccgtaaatctaacgaaaaaacatggcctttgagaagatcaaggttgcaaatcccatcgtcgagatggatggtgatgaaatgacacgagttatctggaagtccatcaaggataagcttattacccctttcgtggagttggatatcaagtacttcgaccttggccttcctcaccgtgatgctactgatgacaaagttactatcgaaagcgctgaagccactaagaagtataatgttgcaatcaagtgtgccaccatcactccagatgaaggccgtgtcactgaatttggcttgaagcagatgtggagaagtccaaatggaaccatcaggaatattctgaatggaactgtatttagagaaccaattatctgcaaaaatgttcccaagcttgtcccaggctggacaaagcccatctgcattggaaggcatgcttttggtgatcagtaccgtgccactgatgctgttatcaagggtccaggaaaactgactatgacttttgagggaaaagatgggaaaactgaaactgaagtgttcacatttaccggtgaaggtggtgttgctatggccatgtacaacactgatgagtccatccgtgctttcgctgaggcatcgatgaacacggcttatgagaaaaagtggccactttatctcagcacaaagaacaccattcttaagaaatacgatggcagattcaaagacatcttccaggaggtgtatgaagccagctggaaatcaaagtatgaggctgctggaatatggtatgaacaccgtctcattgatgatatggtggcttacgctctgaagagtgagggaggctatgtgtgggcatgcaagaactacgatggtgatgtccaaagtgatttcctggcacaaggattcgggtcacttggattgatgacatctgttctggtctgcccagatggaaagacgattgaagctgaagcagctcatggaacggtaactcgtcactacagggtacaccagaaaggtggggagaccagcacaaacagcatagcctccatctttgcttggacacgtggacttgcacacagggcaaagttagatgacaactcaaaactcttggaatttaccgagaagcttgaagctgcttgtgtgggtacagtggagtctggaaaaatgacgaaagatcttgcactcatcattcacggctcgaagctctcaagggacacttacttgaacacagaggagttcatcgatgcagttgcagatgagctcaagacaagacttggcgtcaaagcttaagaagtttgggtcagttcctcagtcataagtgtcttatttggtgggtttgtgagagtggaagaaagaaataaaagagagaacgtttacttaatgggaataatgagaacgatttgtttcatctcctacaatattttccaaacattgtgacatgcttcctttttttacttttgaaattgattttcgagactcttttcattgattcgagttgatgttattccta

SEQ ID NO: 1630 - DNA, 2953 bp, Brassica rapa
  misc_feature (1320)..(1320): n is a, c, g, or t
  misc_feature (2607)..(2607): n is a, c, g, or t
  misc_feature (2705)..(2705): n is a, c, g, or t
  misc_feature (2880)..(2880): n is a, c, g, or t
aaacacaaagcattctaagaatatcttaaagatttcaagaaaaaaacatggggttaacggaggagacacagataactccggtgcaagtcaccgacgatgaagctgctctcttcgccatgcagctagcaagcgcctccgttcttccgatggttttgaaaacggctttagacctcgatcttctcgagatcatggccaagaactcttcccagatgtctccctctgagattgcttctcaacttcagaccaaaaaccctgaagctccgatcatgctcgaccgtatccttcgtcttcttacgtcttactccatcctcacctgctccagtcgtactattcccggcggcgacagcgtcgagaggatttacgggcttggtccggtttgcaagtatttgaccaagaacgaggatggtgtgtccattgctgctctctgtcttatgaaccaagacaaggttctcatggaaagctggtaccatttgaaagatgcaattcttgatggtgggattccattcaacaaggcctatggaatgagcgctttcgagtaccatgggaaggaccttaggttcaacacggtgttcaacaatggaatgtctaaccattcaaccatcacaatgaagaagattcttgagacctataagggtttcgaaggattgacttctttggtggatgttggtggtggcattggtgcgactctcaaaatgattgtctctaagtaccctaaccttaaaggcatcaactttgatctccctcatgtcatcgaagaagctacttctcatcccggtattgagcatgttggaggagatatgtttgtaagtgtccctgaaggtgatgcaattttcatgaagtggatatgccacgattggagcgacaaacattgcgtgaaattcttgaagaactgctacgaggcgcttccagaggatggaaaagtgatattagcagagtgtatactaccagagacaccagactcgagcctgtcgacaaaacaagtagtccatgtggactgcatcatgttggctcacaaccctggtggcaaagaacggaccgagaaagagttcgagaggttagctaaagaatcaggcttcaaaggcatcaaagttgcttgcaacgcttttggtgtttacgttattgagttgctcaagaagatctaaacactgctcccatgtcttatgtctacgtcaacttcaccacctttgtctttttaatgatgatgtttaataatggtttataaagagattgatctagagtttttcattgatctggttgtattgatataatcttatttgtgtttttgtttgtttggaaaacaatcatgtaattttatatttnaaaataaaataatgagattgaatcgcattttcatttctccaagccacaaaaacaaagaaagttaaggcgttattctccgccttcatttagagagagcgagagactgggagagataggttcaagctaatgaaaagtaaataaatagtagcagccattacaacagaggacgagaggagctttgaattcggcggttaattattataacccatcctttttacgcccaaacacacaacacatttgcctttattttctacacattatgatgaatgttactcgatggaaactgcaaaggttttttgcttttcaaatcttctcctcacaacctggagctgcctaacagtcttttccttaactcccatgccacagcatcaatgaactcttctgtattcacataatcatccctcttaaccttggatccgtggatcaacagcgcgagatccttggtcatttttccagactccaccgtccccatacaagccgcttctagtttctcagtaaagttcaacaacgacgcattgctgtccagctttgccctgtgggcaaggcctctggaccaagcaaaaatagaggctatgctgttggtgcttgtttcaccacctttttggtgaactctgtagtggcgtgttactgtgccatgagctgcctctgcttcaatggtctttccatcaggacaaaccaacaccgacgtcatcagtcccagagatccatatccttgggctaagaaatcgctctgcacatctccatcgtagttcttgcatgcccaaacgtaacccccctcactcttcatggcataagccaccatatcatctatcagacgatgctcataccatatcccagcagcttcaaacttagatctccagttagtttcataaacttcttggaatatctttgaatcttccgtcatatgttttgaggatggtgttttttgtggagaggtacagcggccattttttctggtaagctgtgtacatcgatgactcagcaaatgaacggatagactcatcggtgttatacatggccaaagcaacacctccagcaccagtgaaattgaagacttcaaattcggtcttacgtgaagatccacttggctcgaaaatcagtttcagttttcctggttcattaacaacgatatcagtagctctatactgatctccaaaagcatgccttccaatacagattggtttagtccatcctggtacaatgcgagggatatttctgcaaattataggttccctgaagaccgtgccgtttaaaatgttccttatagttccgttaggactcctccanatttttttcaaaccaaactccctaacacgagtttcatcaggagtaatcgtcgcacacttgattgccacgttatactttagagtagcttcagcactctntgtagtaaccttatcatcagtagaatcgcggttagggagtccgagatcaaagtatttgatatccaactccaggtaaggtaaaataagcttgtctttaatgaatttccagataacgcgagtcatctcgtctccatccatttcaacaatcggattggccaccttgatcttctcgaantccatctttgcctcctctctgctgctccgagtgctttgtgcccgcctacgagactgttctgtgatcaaccacc

SEQ ID NO: 1631 - DNA, 1539 bp, Brassica rapa
actcaccagccttgcacgatctgcatctctccgcctgaaaacttctctcgtttgttagatcgccgacgaggttaacatccctttctgatctatcgaatcagtaaaaaaaacaatggcgttcgagaagatcaaggttgcaaatcccatcgtggagatggatggtgatgaaatgacccgagttatctggaagtctatcaaggacaagctgattaccccatttgtggagttggatatcaagtacttcgaccttggtcttcctcaccgtgatgctaccgatgacaaagttactgttgaaagtgctgaagccactaagaagtataatgtggcgatcaagtgtgccaccatcactccagatgaaggccgtgtaacggaatttggcttgaagcagatgtggagaagtcccaatggtaccatcaggaatattctgaatggaactgtatttagagaaccaattctctgcaaaaatgttcccaagcttgtcccaggctggacaaagcccatctgcattggaaggcatgcttttggtgatcagtaccgtgccactgatgctgttatcaagggaccaggaaaactgactatgactttcgagggaaaagatgggaaaactgaaactgaagtcttcacatttactggtgaaggcggtgttgctatggccatgtacaacactgatgagtccatccgtgcttttgctgaggcatcgatgaacactgcttatgagaagaagtggccactttatcttagcacaaagaacaccattcttaagaaatacgatggcagattcaaagacatcttccaagaagtgtatgaagccagctggaaatcaaagtatgaagctgctggaatatggtatgagcaccgtctcattgatgatatggtggcttacgctctcaagagcgagggaggctatgtgtgggcttgcaaaaactatgatggtgatgtccaaagcgatttcctcgcacaagggttcgggtcacttggactgatgacatctgttctggtctgcccggatgggaagacgattgaagctgaagcagcacatggaacggttacccgtcactacagggttcaccagaaaggtggggagaccagcacaaacagcatagcctccatctttgcttggactcgtggacttgcacacagggctaagttagatgacaactcaaaactcttggagtttactgagaagcttgaagctgcttgtgtcggtacggtggagtctggaaaaatgaccaaagatcttgctctcatcattcacggctcaaagctctcgagggacacttacctgaacacggaggagttcatcgatgcagttgcggatgagctcaaaacaagactcggcgtcaaagcttaagacatttgggtaaaacattcggctactcagtcatatgtgtttatctggtgggttcgtgagagtggttgagattgggaggaataaaagaagatattttgcttattaagaacgatttgtttcatctgcaataatattttctaaacattgtcacatgtttccccttttatgaagatttcgaattttatttt

SEQ ID NO: 1632 - DNA, 1793 bp, Hordeum vulgare
tctctctcctctccgtgccaccacagccgccgcctccccaccaacctgcccctccccgctcccgacatccgaggcaggcagcgcctccgccgcgaccgccatggcgttcgagaagatcaaggtcgccaaccccatcgtcgagatggacggtgatgagatgaccagagtattctggcagtctatcaaggacaagcttatcttcccatttttggacttggacatcaaatactttgacttgggagttctgcaccgcgatgcaactgatgacaaggttacagtggaggctgcagaggctactctcaagtacaatgtggctattaagtgtgcaactattactccagatgaagatcgggttaaggagttcaacctaaaacaaatgtggaggagcccaaatggcacaattaggaacattataaacggcaccgtgttcagagagccaattatatgcaagaatgtcccaaagcttgttccaggatggactaagcccatctgcattggaaggcatgctttcggtgatcagtacagagcaactgatgccgttctcaagggacctggcaaactcagactagtttttgagggaaaagacgagacggttgaccttgaggtttttaacttcactggtgctggaggagttgccatggctatgtacaacacagatgagtcaattcgaggttttgctgaagcttctttggcaattgcttatgagaagaaatggccgttgtaccttagcacaaaaaacaccatccttaagaaatatgatggcaggttcaaggacattttccaggagatttatgaagctggctggaaatccaaatatgaggctgccggaatatggtatgaacatcgtctcattgatgacatggttgcctatgcacttaagagcgaaggaggctatgtttgggcttgcaagaactatgacggagatgtgcagagtgatttcttagctcaaggttttggctctttgggcttgatgacgtcagtattgatgtgccctgatggtaaaacaatcgaagccgaagctgcccatggcacagtcactcgtcatttccgtgttcaccagaaaggtggtgaaaccagcacaaacagcattgcttccatctttgcttggacaagaggacttgcacacagggcaaagctagacgacaacgctagacttcttgaatttgcacagaaacttgaggaagcgtgtgtcggaactgtggagtctgggaagatgactaaggaccttgcactccttgttcatggatcttcaaaagtgacaagaagtgattacctgaacactgaagagttcattgacgcagttgctgctgagctcaaatcaagagtgtgaaagtcctgtgccacttccatgcttcaatagtcactgatcgttcgattaagtccttttcggttattccgccttgtctgcgtgctatcatcgtaaaagaccgagcttttattgaccgtagctatgttgacgaaaatgcacgcaatctcgaaatctggtggctgtaatgcacgttcgtacgagagttcatagaagtttcactgagggagaaaagcgcggggcgggcgggcgcacggcgcgttgagagggtgtacgaggcgaggcggggatgacggtacgcagggaaggacggggcgacgcagggtgcgtgcagggtcgtagccgtggacggagcgaggcagcgcgaaccggcggacgcgcccgtctgcgggcaaggagggagagaagcggagaatggaaactgacgggacctacgggtgtctcgggcccgtgggcgggacgcgcggcacgaggtgcgcggtggccg

SEQ ID NO: 1633 - DNA, 1566 bp, Ocimum basilicum
  misc_feature (1544)..(1544): n is a, c, g, or t
gatcctcattgtaagagaaagtagataaacaaaaggcatagggaagagtgatggcattcgacaagatcaaggtggccagccccatcgttgagatggatggagatgagatgacgagggtcatctggcaaatgatcaaggacaagttgatcttccctttcttggagttggatattaagtactttgaccttggcattacgcaccgtgatgccacggatgataaagtgaccattgagagtgcagaagctactcttaagtataatgtggcaattaagtgtgcgacaattactccagatgaggctcgtgttaaggagtttggcttgaagcagatgtggaagagtccaaatggtacaattaggaacattttgaatggcactgtctttagagaaccaattctctgcaaaaatgttcctcgacttatcccaggttggacaaagcctatatgcattggaagacatgctttcggagatcaataccgagcaactgatgctgtaattaaaggacctggaaagcttaaattggtttttgttccagaatcaggtgaaaagacagaaatggaggtctacgacttcactggtgctggtggagttgctttgtcgatgtacaacactgatgagtccattcggtcttttgctgagtcttcgatgaataccgcatacctgaaaaagtggccattgtatcttagcacaaagaataccattctcaagaaatacgacggcagattcaaggacatatttcaagaagtttatgaatcacaatggaaagcaaagttcgaggaggcaggaatatggtatgagcaccgtctcattgatgatatggttgcatatgctctgaagagtgaaggaggctatgtatgggcttgcaagaactatgatggagatgtgcagagtgacttcttagcacaaggctttggatctcttgggctgatgacttcagtcttggtgtgccctgatgggaagacaatcgaggctgaagcagcccacggaactgttacgcgacactacagggttcatcagaaaggaggtgaaaccagtaccaatagcattgcctcaatctttgcttggactaggggtcttgcacacagggctaagctggatgacaatgcaaagctcttggatttcactgagaaactagaagcagcttgtatcggtgttgtcgaatctggaaagatgaccaaggatctcgccctcatcatccacggatccaagttggcacgaagccagtatttgaacaccgaagagtttattgatgcagttgctgatgagcttaaagcaaaactttaatcctaagttctattgagtgggttgcattggaagttgattttgttgcaatgcgaatgtagtgtggtgagatgcaggacatgattgatggtcagaagcttactcttgaataatttatcttccattttatgctgtatctctacttttcttgctgtactgactgggttttaattcgaaacaattcaaatatcaaaacaagcatattatggcatcaatggaagaaatctgggcagattgtttcaaatactaggcttttaaggcagaagnttggtaaaatgttgtgtaattt

SEQ ID NO: 1634 - DNA, 1783 bp, Phaseolus coccineus
ggaaatagcagcaactcacttggttttgctaaactctatctcttcacatcactcatttctcacctaaccttcttctttagttctcttcttctcagatcagaaactccgccatggcgttccagaagatcaacgtcgccaatcctatcgtcgagatggatggagatgaaatgactagggttatctggaagtcaatcaaggacaagctcattttgcctttcttggagttggacataaagtattatgaccttggtcttccataccgtgatgagaccgatgataaagttacaactgatagcgcagaagctactctcaaatacaatgtagcaatcaagtgtgcaactatcactccagatgaagctcgtgtgaaggagtttggcctgaagcaaatgtggaagagtccaaatgggacaattaggaacattttgaatggtactgtcttcagagaaccaattctttgcaaaaacattccgcgccttgttcctggttggacaaaggcaatatgcattggaagacatgcttttggtgaccaatatcgggctactgactcagtaattaaaggagctggaaagctgacgctggtgtttgttccagaaggcggaggtgagaagactgaattagaggtttttaactttaaaggtgaaggaggcgtttctttagctatgtacaatactgatgagtctattcgttcttttgccgaggcttctatgacaactgctttagagaaaaagtggccactttatcttagtaccaaaaatacaattcttaagaaatatgatggaagattcaaggacatatttcaagaagtttacgaggcaagctggaaatcaaagtttgaggctgctggtatatggtatgagcatcggctcattgatgatatggtggcttatgccctcaagagtgaaggaggttacgtatgggcatgcaaaaactatgatggtgatgtgcagagtgatttcttagctcaaggttttggatcattgggtttgatgacatctgtattggtttgtcctgacggaaagactattgaagcagaagcagcccatggaacagttacccgtcattttagggttcatcagaaaggaggcgaaaccagcacaaatagcatagcatccatctttgcctggacaagaggtctagcccacagggcaaaactggatgacaatgctaaactattggatttcactgaaaagctagaggcagcttgcattggagtagtagaggctgggaagatgaccaaggacttggcacttattcttcatggatccaagctttcaagagagcactatttgaacacagaggaattcatcgatgccgtggcagccgagcttagagataagatttctgcataggcttgatttaaagacggacggaaaaagactagaccaacaaggaacaaacatgtgctactctctattctgaagaaataagagaaggaagagaagcactgacccttggctgcttttacttcatttgtgggttgggaattgcgggtttttcttcttctctgtattgtttgaactgatttgtcctgtgattttgaactcatcccttccaacttccttacttattatggattttgttgtcttcttctgcatatacggcaccgcagaaagtaaaggtaaacatcattccaaatttatagtggctcaccacagcaaataaatacaacatgaccggcaaagtggctccaccttaataaaatactacggaatggccagcaactatacaagttcttgaaaaacctaattaatctctttcttattttgatgttaattttgaaatt

SEQ ID NO: 1635 - DNA, 2531 bp, Brachypodium distachyon
ggtccgccggccaaactccgccgtgtcgcttagttcaactgcttcgttctctccgcgctccggtctccacacttccacagtccaggctcgacaggccgggagagctccaattccctctcgtctcgtccccggcgcaggctgtcccgcgatccaagcgcggcgctcatggcgttcgagaagatcgaggtcgccaaccccatcgtcgagatggacggtgatgaaatgactcgagttatatggaaatggatcaaagctaagcttatcttccctttcctggacttggacataaaatactttgacttaggtctacctaatcgtgatgctactggtgacaaagtaacaatagaaagtgcagaagctaccctaaagtataatgtggcaatcaaatgcgcaactgtcaccccagatgaaggacgagttaaagagtttaatttaaaagctatgtggaggagtccaaatgggacgataaggaacatcttgaatggaactgttttccgtgaaccaatcatctgcaagaatgttcctcggctagtgcctggatggaccaaacccatatgcattgggaggcatgcttttggtgatcaataccgagcaacagatacagttatcagagggccaggaaagcttaagttaatatttgatggcatagacgaacaaatagagttggatgtgttcaactttagtggtgctggtggagtagcattgtctatgtataacactgatgagtctattcgggcatttgctgaagcctctatgaacgtggcttaccagaaaagatggccactatatcttagtaccaagaacactatcctcaaaaaatacgacggaaggtttaaagacatattccaagaaaactatgaagcaaaatggagaggcaagtttgaggatgcaggaatatggtatgaacatcggctgatcgatgatatggtagcgtatgcccttaagagtgatggtggctatgtttgggcttgcaagaattatgatggagatgtgcagagcgatctaattgctcaaggttttggatcactaggtctcatgacatctgttctggtctgccctgatggtagaacaattgaagctgaagctgcacatggtacagtcacacgacattatagagtccaccaaaaaggaggcgaaactagtacaaacagcattgcttcaatctttgcatggtcgactggactagcacatagggcaaagctcgatgacaacaaaagactgttggatttcacacaaaaacttgaagctgcttgtgttgggacagtagagtctgggaagatgacaaaggatctagctcttctcatacatgggcccaatgttacacgagataagtatctgaacacagtagagttcattgatgcggttgctgaggagttgaggacaagattgtcagtaaaatcaaagttgtgaagatactactagagcggatagggcaagggacttgttaggatcctataatacaaggtttacgtttgtactacgataagagctgtcttccctacagtgctcaaatagagcctctggtgacagtctgaatgcacctccgaacaatgaaggaagatgctgtctagctcggaaataagtaggctcttttttatcagattctttggtgatgatcgagtcattttcatgtagctcttccgatagtgatgtccaaatcaagttgggcttcttacacctacacacccgaagcgatgtttgtaccaaacataataagccactttattcaaacattgtaatgtcacgacatgaaatcaaaagccaatttgaaatctgaagctggtcatccaaggcattgatgatattagcgacatgtttctttggtgcttcagtttcctccaatcacagggcaacctgaagccgatgcggcagatgcaggggtgctcaagaagcttgcgaggaagttgccgcgctcgtagaagtactctgtcttctgaaccttcatctcttcatcaacatggaagatgcagacgccgaagaactcgacgcgctggccgtgaggcgggtgctccttgaatggcccctccatgtgcccccagtgccggaacttgaaggcgaccttcggcgggccgctgtacacttcgagcacctcgatggcgaagccccgggggaacgccgtcaggaacgtcgacatgctggactctagcgtctccttctccgggtcgtagatgcggtgctccggcggcagggtggtcgccaggaacgcgttgtagccgccgatggccgacagttccttccgcgtcagaggcttcatcccgtttgtgctggcgctgtatccctggtagtgaacgctcttctggtcctcggggcgcagcttgtggacaagctccatctcccaggtcttgagcaagcgctgcactttctcttccagggatccctccggccattccttggtcctctcttcctcgaagagcttgttcaccatgtcgtagttgggaggggctccgagcctccacacggtgttcttctcgccctcgccgtgcaagaacgatcggtacttgtctcctcccgcttcagcagaggccatagct

SEQ ID NO: 1636 - DNA, 1552 bp, Brachypodium distachyon
gttctctccttctccccgtcgtgccacaccgcagcagccgccgcttccccacctgccccgctcccgatctccgaggcaagcagcgccgccgcggccgccatggcgttcgagaagatcaaggtcgccaaccccatcgtcgagatggacggtgatgagatgaccagagtattctggcagtctatcaaggacaagcttatcttcccatttttggacctggacatcaagtattatgacttgggagttctgcaccgtgatgcaactgatgacaaggtcactgtggaggctgcagaggctactctcaagtacaacgtggctattaagtgtgcaactattacaccagatgaagatcgggttaaggagttcaacctaaaacaaatgtggaggagcccaaacggcacaattaggaacattataaacggcactgtgttcagagagccaattatatgcaagaatgttccaaagcttgttccagggtggactaagcccatttgcattggaaggcatgcctttggtgatcagtaccgagcaactgatgcagttcttaagggacctggcaaactcagactagtttttgagggaaaagaagagacggttgatctggaggtttttagcttcactggtgctgggggtgttgccttgtctatgtacaacacagatgagtcaattcaaggttttgctgcggcttctatggcaactgcttatgataagaaatggccattgtacctgagcacaaaaaacacaatcctgaagaaatatgatggcaggttcaaggacattttccaggaggtctatgaagccgagtggaaatccaagtttgaggctgctggaatatggtatgaacatcgtctcattgatgacatggttgcctatgcacttaagagtgaaggaggttatgtttgggcttgcaagaactacgatggagatgtgcagagtgatttcttagctcaaggttttggctctttgggattgatgacatcagtgttggtatgccctgatggaaaaaccattgaagctgaagctgcccatggcacagttacccgtcatttccgtgttcaccagaaaggaggtgaaaccagcacaaacagcattgcttcaatctttgcttggacaagaggacttgcacacagggcaaagctagatgacaatgctagacttcttgaatttgcacaaaaacttgaggacgcatgtgtcggaactgtggagtcagggaagatgacgaaggaccttgcacttcttgttcagggatcttcaaatgttacaagaagccattacctgaacactgaagagttcattgatgcagttgccgctgagctccgaacaagattggcagccaattgaactcactacgaaagctcgtccacatgaatgcttcattgcccgtcgatttaaatcattttgcttatgtggccattatatgtcacgttttcatcttgaacagaatgagcttttactgcaccatcgcaaattattgtcaaaatgcaagcgattctattagatgctgatgttacgtaagtggagctcttaataaaggacatagaacagtgttcagctt

SEQ ID NO: 1637 - DNA, 1633 bp, Theobroma cacao
  misc_feature (1233)..(1233): n is a, c, g, or t
cggggggcccagttttgatttttcatctaaaaaccacatacatttgagcagaaatcggttaggcttaacactaaaagcaatggcttttgagaagatcaaggtcgtcaatcccatcgttgagatggatggagatgaaatgaccagagttatttggaaatctatcaaggataagctcatttttccctttttggagttggacattaagtactttgaccttggccttccatatcgtgatgctactgatgacaaagttacagttgaaagtgcagaagctactcttaagtacaatgtagccatcaagtgtgctactattactccagatgaagctcgtgttaaggagtttaacttaaagcaaatgtggaagagtcctaatgggacgattaggaacattttgaacggtactgtctttagagaaccaattatttgcaaaaatgtcccgcgattggtcccaggttggacgaagcctatatgcattggaaggcatgcttttggtgatcaatatcgagcaactgatgctgtcattaaaggacctgggaaactaaaacttgtttttgtgccagagggacaagatgagaagacagagtgggaagttttcaacttcactggtgatggaggagtttcattggccatgtataacacagatgagtccatacgtgcttttgctgaggcttctatgaacactgcttatcagaaaaagtggcccctttatcttagtaccaaaaatactattcttaagaagtatgatggaagatttaaggacatatttcaagaggtttatgaggctaagtggaaatcaaaatatgaggctgctgggatatggtatgaacaccgtctcattgatgatatggtggcatatgctgtcaagagtgaaggaggttatgtgtgggcatgcaagaactatgatggtgatgtccaaagtgatttcttagcccaagggtttggatctcttggattgatgacatctgtgctggtgtgcccagatgggaagacaatagaagcagaggctgctcatggtacggttacgcgacattacagagttcaccaaaagggtggtgaaaccagcacaaacagcatagcatccatctttgcttggacacgtgggcttgcacacagggcaaaattggatgacaatatcagactcttggagttcactgagaaacttgaggcagcttgtattggagctgtggaatctgggaagatgaccaaagatcttgcactgatcattcacgggtntaagcttgctagggaccaatacctgaacactgaggatttcattgatgctgtggcagaagagctcagagcaagactttctgttaaagcatgattttaaacatggttcagatatgcaagggttgagagctcttgttgatgctttggggcttttgcagggaaataataaaagcgtgaatgtgaggtgagaaggctggggatggcatttgatggacattatttgtaaggctctgattatgcgctatttactgtatgtggattttgttcaatctccctggttgtatccttcactctggctgtgaccaaatgatgaaagaattgagataatgatctcacatcattgaaacttatctattttctatccttttggtagcaattattgaagtttgtgtaatgtaggaca

SEQ ID NO: 1638 - DNA, 1546 bp, Brassica napus
gatgcattgtgtccggcccgccctcgagactagacgctctgcatctctccgcctgaaaacttctctcgtttgttagatcgccgacgaggttaacatccctttctgatctatcgaatcattaaaaaacaatggcgttcgagaagatcaaggttgcaaatcccatcgtcgagatggatggtgatgaaatgactcgagttatctggaagtccatcaaggacaagcttattaccccttttgtggagttggatatcaagtacttcgaccttggtcttcctcaccgtgatgctaccgatgacaaagttactgttgaaagtgctgaagccactaagaagtataatgtggcgatcaagtgtgccaccatcactccagatgaaggccgtgtaacggaatttggcttgaagcagatgtggagaagtcccaatggtaccatcaggaatattctgaatggaactgtatttagagaaccaattctctgcaaaaatgttcccaagcttgtcccgggctggacaaagcccatctgcattggaaggcatgcttttggtgatcagtaccgtgccactgatgctgttatcaagggaccaggaaaactgactatgactttcgagggaaaggatgggaaaactgaaactgaagtgttcacatttactggtgaaggcggtgttgctatggccatgtacaacactgatgagtccatccgtgcttttgctgaggcatcgatgaacactgcttatgagaagaagtggccactttatcttagcacaaagaacaccattcttaagaaatacgatggcagattcaaagacatcttccaggaagtgtatgaagccagctggaaatcaaagtatgaagctgctggaatatggtatgagcatcgtctcattgatgatatggtggcttacgctctgaagagcgagggaggctatgtgtgggcttgcaaaaactatgatggtgatgtccaaagcgatttcctcgcacaagggttcgggtcacttggactgatgacatctgttctggtctgcccggatgggaagacgattgaagctgaagcagcacatggaaccgttacccgtcactacagggttcaccagaaaggtggcgagaccagcacaaacagcatagcctccatctttgcttggactcgtggacttgcacacagggctaagttagatgacaactcaaaactcttggagtttactgagaagctcgaagctgcttgtgtcggtacagtggagtctggaaaaatgaccaaagatcttgctctcatcattcatggctcaaagctctcgagggacacttacctgaacacggaggagttcatcgatgcagttgcggatgagctcaaaacaagactcggcgtcaaagcttaagacatttgggtaaaacattcggctactcagtcatatgtggtttatctggtgggtttgtgagagtgggaggaataaaagaattcaagatattttgcttattaagaacgatttgtttcatctgcaataaatattttctaaaaattgtcacatgtttccccttttatgaaaatttcgaattt

SEQ ID NO: 1639 - DNA, 1583 bp, Brassica napus
gcccttttcacctactccactcaccaccatcgaccatctctgtctcccgccggaaccacttctctcgtttgcagatcgccgaagactagaacgtccaatccgatcgtctggatccgtaaatctaacgaaaaaacatggcctttgagaagatcaaggttgctaatcccatcgtcgagatggatggtgatgaaatgacccgagttatctggaagtccatcaaggataagcttattacccctttcgtggagttggatatcaagtacttcgaccttggccttcctcaccgtgatgccactgatgacaaagttactatcgaaagcgctgaagccactaagaagtataatgttgcaatcaagtgtgccaccatcactccagatgaaggccgtgtcactgaatttggcttgaagcagatgtggagaagtccaaatgggaccatcaggaatattctgaatgggactgtatttagagaaccaattatctgcaaaaatgttcccaagcttgtcccaggatggacgaagcccatctgcattggaaggcatgcttttggtgatcagtaccgtgccactgatgctgttatcaagggtccaggaaaactgactatgacttttgagggaaaagatgggaaaactgaaactgaagtgttcacatttaccggtgaaggtggtgttgctatggccatgtacaacactgatgagtccatccgtgctttcgctgaggcatcgatgaacactgcttatgagaaaaagtggccactttatctcagcacaaagaacaccattcttaagaaatacgatggcagattcaaagacatcttccaggaggtttatgaagccagctggaagtcaaagtatgaggctgctggaatatggtatgaacaccgtctcattgatgatatggtggcttacgctctgaagagtgagggaggctatgtgtgggcatgcaagaactacgatggtgatgtccaaagtgatttcctggcacaaggattcgggtcacttggattgatgacatctgttctggtctgcccagatggaaagacgattgaagctgaagcagctcatggaacggttacccgtcactacagggtacaccagaaaggtggggagaccagcacaaacagcatagcctccatctttgcttggactcgtggacttgcacacagggctaagttagatgacaactcaaaactcttggaatttaccgagaagcttgaagctgcttgtgtgggtactgtggagtctggaaaaatgacaaaagatcttgcactcatcattcacggctcgaagctctcaagggacacttacttgaacacagaggagttcatcgatgcagttgcagatgagctcaaggcaagacttggcgtcaaagcttaagaagtttgggtcagttcctcagtcataagtgtcttatttggtgggtttgtgagagtggaagaaagaaataaaagagagaacgtttacttaatgggaataatgagaacgatttgtttcatctcctacaatattttccaaacattgtgacatgcttcctttttttacttttgaaattgattttcgcgactcttttcattgaaaaaaaaaaaa

SEQ ID NO: 1640 - DNA, 1562 bp, Brassica napus
  misc_feature (26)..(27): n is a, c, g, or t
  misc_feature (29)..(30): n is a, c, g, or t
  misc_feature (34)..(35): n is a, c, g, or t
  misc_feature (37)..(41): n is a, c, g, or t
  misc_feature (83)..(83): n is a, c, g, or t
  misc_feature (172)..(172): n is a, c, g, or t
  misc_feature (183)..(183): n is a, c, g, or t
  misc_feature (228)..(228): n is a, c, g, or t
  misc_feature (232)..(232): n is a, c, g, or t
  misc_feature (1315)..(1315): n is a, c, g, or t
  misc_feature (1327)..(1327): n is a, c, g, or t
  misc_feature (1440)..(1440): n is a, c, g, or t
  misc_feature (1449)..(1449): n is a, c, g, or t
  misc_feature (1474)..(1474): n is a, c, g, or t
gatttttaaatatttcacggcagagnngnncagnnannnnnggttgatcacagaacagtctcgtaggcgggcacaaagcactnggagcagcagagaagaggcaaagatggaattcgagaagatcaaggtggccaatccgattgttgaaatggatggagacgagatgactcgngttatctgganattcattaaagacaagcttattttaccttacctggagttggatancaantactttgatctcggactccctaaccgcgattctactgatgataaggttactacagagagtgctgaagctactctaaagtataacgtggcaatcaagtgtgcgacgattactcctgatgaaactcgtgttagggagtttggtttgaaaaaaatgtggaggagtcctaacggaactataaggaacattttaaacggcacggtcttcagggaacctataatttgcagaaatatccctcgcattgtaccaggatggactaaaccaatctgtattggaaggcatgcttttggagatcagtatagagctactgatatcgttgttaatgaaccaggaaaactgaaactgattttcgagccaagtggatcttcacgtaagaccgaatttgaagtcttcaatttcactggtgctggaggtgttgctttggccatgtataacaccgatgagtctatccgttcatttgctgagtcatcgatgtacacagcttaccagaaaaaatggccgctgtacctctccacaaaaaacaccatcctcaaaacatatgacggaagattcaaggatatattccaagaagtttatgaaactaactggagatctaagtttgaagctgctgggatatggtatgagcatcgtctgatagatgatatggttgcttatgccatgaaaagtgaggggggttacgtttgggcatgcaagaactacgatggagatgtgcagagcgatttcttagcccaaggatatggatctctgggactgatgacgtcggtgttggtttgtcctgatggaaagaccattgaagcagaggcagctcatggcacagtaacacgccactacagagttcaccaaaaaggtggcgaaacaagcaccaacagcatagcctctatttttgcttggtccagaggccttgcccacagggcaaagctggacagcaatgcgtcgttgttgaactttactgagaaactagaagcggcttgtatggggacggtggagtctggaaaaatgaccaaggatctcgcgctgttgatccatggatccaaggttaagagggatgattatgtgaatactgaagagttcattgatgctgtggcntgggagttaagnaaaagactgttaggcagctccaggttgtgaggagaagatttgaaaagcaaaaaacctttgcagtttccatcgagtaacattcatcatcataatgtgtagaaaataaaggcaantgtgttgtntgtttgggcgtaaaaaggatgggtnataataattaaccgccgaactcaaagctcctctcgtcctctgttgtaatggctgctactatttatttttcattagcttgaacctatca

SEQ ID NO: 1641 - DNA, 1338 bp, Brassica napus
  misc_feature (1175)..(1175): n is a, c, g, or t
  misc_feature (1196)..(1196): n is a, c, g, or t
gacgatctgcatctctccgcctgaaaacttctctcgtttgttagatcgccgacgaggttaacatccctttctgatctatcgaatcagtaaaaaaaacaatggcgttcgagaagatcaaggttgcaaatcccatcgtggagatggatggtgatgaaatgacccgagttatctggaagtctatcaaggacaagctgattaccccatttgtggagttggatatcaagtacttcgaccttggtcttcctcaccgtgatgctaccgatgacaaagttactgttgaaagtgctgaagccactaagaagtataatgtggcgatcaagtgtgccaccatcactccagatgaaggccgtgtaacggaatttggcttgaagcagatgtggagaagtcccaatggtaccatcaggaatattctgaatggaactgtatttagagaaccaattctctgcaaaaatgttcccaagcttgtcccaggctggacaaagcccatctgcattggaaggcatgcttttggtgatcagtaccgtgccactgatgctgttatcaagggaccaggaaaactgactatgactttcgagggaaaagatgggaaaactgaaactgaagtcttcacatttaccggtgaaggcggtgttgctatggccatgtacaacactgatgagtccatccgtgcttttgctgaggcatcgatgaacactgcttatgagaagaagtggccactttatcttagcacaaagaacaccattcttaagaaatacgatggcagattcaaagacatcttccaagaagtgtatgaagccagctggaaatcaaagtatgaagctgctggaatatggtatgagcaccgtctcattgatgatatggtggcttacgctctcaagagcgagggaggctatgtgtgggcttgcaaaaactatgatggtgatgtccaaagcgatttcctcgcacaagggttcgggtcacttggactgatgacatctgttctggtctgcccggatgggaagacgattgaagctgaagcagcacatggaacggttacccgtcactacagggttcaccagaaaggtggggagaccagcacaaacagcatagcctccatctttgcttggactcgtggacttgcacacagggctaagttagatgacaactcaaaactcttggagtttactgagaagctngaagctgcttgtgtcggtacngtggagtctggaaaaatgaccaaagatcttgctctcatcattcatggctcaaagctctcgagggacacttacctgaacacggaggagttcttcgatgcagttgcggatgagctcaaacaagactcggcgtcaaagcttaaga

SEQ ID NO: 1642 - DNA, 1614 bp, Brassica napus
actccactcaccaccatcgaccatctctgtctcccgccggaaccacttctctcgtttgtagatcgccgaagattagaacgtccaatccgatcgtctggatccgtatatctaacgaaaaaccatggccttcgagaagatcaaggttgcaaatcccatcgtcgagatggatggtgatgaaatgacccgagttatctggaagtccatcaaggacaagcttattacccctttcgtggagttggatatcaagtacttcgaccttggccttcctcaccgtgatgctaccgatgacaaagttactatcgaaagcgctgaagccactaagaagtataatgttgcaatcaagtgtgccaccatcactccagatgaaggccgtgtcactgaatttggcttgaagcagatgtggagaagtccaaatggaaccatcaggaatattctgaatggaactgtttttagagaaccaattatctgcaaaaatgttcccaagcttgtcccaggctggacgaagcccatctgcattggaaggcatgcttttggtgatcagtaccgtgccactgatgctgttatcaagggtccaggaaaactgactatgacttttgagggaaaagatgggaaaactgaaactgaagtgttcacatttactggcgaaggtggtgttgccatggccatgtacaacactgatgagtccatccgtgcgtttgctgaggcatcgatgaacactgcttatgagaaaaagtggccactttatcttagcacaaagaacaccattcttaagaaatacgatggcagattcaaagacatcttccaggaggtgtatgaagccagctggaaatcaaagtatgaggctgctggaatatggtatgaacaccgtctcattgatgatatggtggcttacgctcttaagagcgagggaggctatgtgtgggcatgcaagaactacgatggtgatgtccaaagtgatttcctggcacaaggattcgggtcacttggattgatgacatctgttctggtctgcccggatggaaagacgattgaagctgaagcagctcatggaacggtaactcgtcactacagggtacaccagaaaggtggggagacgagcacaaacagcatagcctccatctttgcttggactcgtggacttgcacacagagctaagttagatgacaactcaaaactcttggaatttaccgagaagcttgaagctgcttgtgtgggtacggtggagtctggaaaaatgacgaaagatcttgcactcatcattcacggctcgaagctctcaagggacacttacttgaacacagaggagttcatcgatgcagttgcagatgagctcaagacaagacttggcatcaaagcttaagaagtttgagtcagttcctgaatcataagtgtcttatttggtgggtttgtgagagtggaagaacgaaataaaagagagaacgtttacttaatgggaataatgagaacgatttgtttcatctcctacaatattttccaaacattgtgacatgcttcctttatttttgttattgattcgagttgatgttattcctatgtgcattgctatatattcctgtatgcgtgataagaagttaacggcggtggtcttctgac

SEQ ID NO: 1643 - DNA, 1327 bp, Manihot esculenta
gaaaatcgacgatggcttttgagaagatcaaggtcgccaaccccatcgttgagatggacggagatgaaatgactcgggttttctggaaatcaatcaaagataagcttattttccccttcctggagttggacataaaatactttgaccttggccttccccatcgcgatgccactgatgacaaagttacagttgaaagtgcagaggctacccttaagtacaatgtagcaatcaagtgtgcaacaataactccagatgaagctcgtgtgaaggagtttaacttgaagcagatgtggaagagtccaaatgggacaattaggaatattttaaatggtactgttttcagagaaccaattatttgcaagaatgttccccggcttgtcccaggttggtcaaagccgatttgtattggaaggcatgcatttggtgaccaatatcgagcaactgatacagttattaaaggagctggcaaactcaaattggttttcgtacctgaaggacaggatgagaagacagagttggaggttttcaactttactggtgatgggggggtggcattgtccatgtataacactgatgagtcaatctgcgcttttgctgaggcatctatgaacactgcttaccagaaaaaatggccactttatcttagcacaaaaaataccatccttaagaagtatgatggaagattcaaggacatttttcaggaagtctatgaggccaactggaagtcaaagtttgaggctgctggaatatggtatgaacatcggctcattgatgatatggtggcttatgctctcaagagtgaaggtggttacgtatgggcatgcaagaactatgatggagatgtgcagagtgatttcttagctcaaggttttggatcacttggattgatgacatctgtactggtgtgcccagatggaaaaactattgaagcagaggcagcccatggtaccgtaactcgacattacagggtttatcagaaaggtggtgaaaccagcacaaacagcatagcttctatctttgcttggtcacgaggtcttgcacacagggctaagttggatgacaatgaaagactcttggatttcacccagaagcttgaggcagcatgtattggagcagtggagtctggcaagatgaccaaggatcttgcattgcttattcatggacctaaggttactcgggaccagtatctcaatactgaagaattcattgatgctgtggcagcagaactgaaagcaaaacttggcatcaccgaataattgtatgtggatattctccagtatctcctagcgctggaatgatatctaatgttgcaatttctgcatttatc

SEQ ID NO: 1644 - DNA, 1409 bp, Manihot esculenta
ataacatggcgttcgagaagattaaggtctccaatcccatcgttgagatggatggagatgaaatgacaagaattatttggaaatccattaaagataagcttattttcccatttttggatttggatatcaagtattttgaccttggacttcccaatcgtgatgccactaatgataaagtcaccatagaaagtgctgaagccactcttaaatataatgtggcaattaagtgtgcaactatcactccagatgaagatcgggtcaaagagtttcacttgaaaagaatgtggaagagtccaaatgggactattcgtaacattttaaatggtaccgtttttcgagaaccaattatctgcaaaaacattccacgtcttgtctcaggttggacaaagccgatctgcattggaaggcatgcatttggtgaccaataccgagcaactgatacaactatacaaggaccaggaaaacttaagctggtatttgtaccagatggatgtggtgagaagacagaatttgaggttttcaatttcactggggctggaggtgtagcattgtctatgtataacactgatgagtccattcgtgcatttgctgaggcttcaatgaatactgcttaccaaaagaagtggccactttatcttagcacaaaaaatactattctcaaaaaatatgatggaagattcaaggacatctttcaggaagtttatgaaagtcaatggaaatccaagtttgaggctgcagggatatggtatgaacatcgtctaatagatgatatggttgcctatgccctcaaaagtgaaggaggttatgtatgggcatgcaaaaattatgatggggatgttcagagtgatttcttagcccaaggatttgggtctcttgggttgatgacttctgtactggtgtgtcctgatggaagaactattgaagcagaagctgcccatggcacagttactcgtcattatagggttcatcagaaaggaggtgaaaccagcacgaacagcatcgcatcaatttttgcttggtcacgaggtcttgcacacagggcaaagttggatagaaatgccagacttttggactttactgacaaactggaaaaagcctgtgttggagctgttgaatcagggaagatgaccaaggatcttgcactacttatccatgggcctaaggtcacgagggatcaatatctgaatacggaggagttcattgatgctgtggctgaggaactgatagcaagattatctgccaaagcaaagttgtaattttaggtctctaacctggccagatgctttctgataatgtctgatgcatttgtttcacttcatatatggtataacttctataattttcagttttcagccatctttgtctactcttcaatggtatggttagggggaaacaaaattggttgttat

SEQ ID NO: 1645 - DNA, 1343 bp, Ricinus communis
gaacaaatccgaagcagatcatagaaatggaactcgacaagattaaggtcgacaatcccatcgttgagatggacggagatgaaatgactagaattatttggaagtctatcaaaactaagcttatttttccatttttggatttggatatcaagtattttgaccttggactccctaaccgggatgccactgatgatcaagttaccgtagaaagtgctgaagccactcttaagtataatgtggccatcaagtgtgcaactattactccagatgaaactcgggtcaaggaatttaatttgaaaagaatgtggaagactccaaatgggacaattcgtaacattttgaacggtactgtttttagagaaccaatcatctgcaaaaacgttccacgccttgttccaggttggaccaagccaatctgcattgggaggcatgcttttggtgaccagtaccgagcaactgatgcaattattcaaggaccaggaaaacttaagctggttttcgtaccaggtggacgtgatgagaagacagaatttgaggttttcaagttcactggagctggaggtgtagcactgtccatgtacaacactgaggagtctattcatgcatttgctgaggcctcaatgagcactgcttaccaaaagaagtggccactttatcttagcacaaagaatactattcttaaaaaatatgatggaagattcaaggacatatttcaggaagtttatgaaactagatggaaatccaagtttcaggctgcaggcatatggtatgaacaccgtctaattgatgatatggttgcttatgccattaaaagtgaaggaggttatgtatgggcatgcaaaaattatgatggagatgttcagagtgatttcttagcccaaggttttgggtctcttgggttgatgacatctgtactggtgtgccccgatggaaggactattgaagctgaagcagcccatggcactgttacccgccactatagagttcatcaaagaggaggtgaaaccagcacaaatagcatagcatcaatttttgcttggtcgcgaggtcttgcacacagggcaaagctggatgggaatgccagactcttggagtttactgagaaactggaagcagcgtgtgttggagctgttgaatcagggaagatgaccaaggatcttgcacttcttattcatgggcctaaggtcactagggctcagtatctgaatactgaggagttcattgatgctgtggctgaggagttgagattaagattgtccgcaaaggctaagttgtaaactccaggtacctaacctggctatgtgcttgcttgcaataatatttattttgaagtttaactctta

SEQ ID NO: 1646 - DNA, 1559 bp, Ricinus communis
ttgtatctttcttcacatgccgtctcctaccttctctgttcattctcactaatttccacatctaaactgttacagtaggagctagaactctcctcctccctatctctttcatctttaaactcaaaacccattttccatttttttctttagttatcatggctttcgagaagatcaaggttgccaatcccattgttgagatggatggagatgaaatgactcggattttctggaaatcaatcaaggataagcttattttcccctttttggagctagacataaagtactttgaccttggtcttcctcatcgtgatgccactgatgacaaagttacaattgaaagtgcagaagctacgcttaagtacaatgtagcaatcaagtgtgcaacgataactccagatgaagctcgtgtaaaggagtttaacttgaagcagatgtggaagagtccaaacgggacaatcaggaatattctaaatggtactgttttcagagaaccaattatttgcaagaatgttccacggcttgtcccaggttggacaaagccaatttgcattggcagacatgcgtttggtgatcaataccgggcaactgatgcagtaattaaaggagctggaaaactcaaactggtgtttgtacctgaaggacaggatgagaagacagagttagaggtttacaactttacaggtgctgggggagtggcattgtccatgtacaacactgatgagtccattcgtgcttttgctgatgcttctatgaacactgcataccagaagaaatggccactttatcttagcacaaaaaataccatccttaagaagtatgatggaagattcaaggacatttttcaggaagtctatgaggccagctggaaatcaaagtttgaggctgctgggatatggtatgaacaccggcttattgatgacatggtggcttatgctctcaagagtgaaggtggttatgtatgggcatgcaagaactatgatggagatgtgcagagtgatttcttagcccaaggttttggatcacttggattaatgacgtctgtgctggtttgcccagatggaaagacgattgaagcagaggcagcccatggtactgttactcgacactacagagttcatcagaaaggtggtgaaaccagcacaaacagtattgcttctatttttgcttggtcacgaggtcttgcacacagggctaaattggatgacaatgctagactcttggatttcactgaaaagcttgaagcagcttgtattggagtagtggagtctggaaagatgaccaaggatcttgcattgctcattcatggatccaaggttactcgagatcagtatctcaataccgaagagttcattgatgcagtggcagcagatctggcagaaagactcagcaaagcgtaattgccatggtaggtgacatgaagaatgaagcggatgaaataaaagagaaagggaaagataaggggttatggctcttatttgtttaccatgttagatttagcagacccctcatgtttgatttacttccatatcattttcaatgcgattattaatggtgcacta

SEQ ID NO: 1647 - DNA, 1435 bp, Centaurea maculosa
  misc_feature (39)..(39): n is a, c, g, or t
  misc_feature (72)..(72): n is a, c, g, or t
  misc_feature (87)..(87): n is a, c, g, or t
  misc_feature (92)..(93): n is a, c, g, or t
  misc_feature (133)..(133): n is a, c, g, or t
  misc_feature (285)..(285): n is a, c, g, or t
  misc_feature (294)..(294): n is a, c, g, or t
  misc_feature (327)..(327): n is a, c, g, or t
  misc_feature (348)..(348): n is a, c, g, or t
  misc_feature (417)..(417): n is a, c, g, or t
  misc_feature (448)..(448): n is a, c, g, or t
  misc_feature (450)..(450): n is a, c, g, or t
  misc_feature (457)..(457): n is a, c, g, or t
  misc_feature (570)..(570): n is a, c, g, or t
  misc_feature (662)..(662): n is a, c, g, or t
  misc_feature (669)..(669): n is a, c, g, or t
  misc_feature (813)..(813): n is a, c, g, or t
atggagatgaatgactcgcgtcttttgggaatcattaanaataagctcatctttcccttcttagatctcganataaagtattatgancttgnncttcttaatcgtgatgccaccgatgataaagttaccgtanaaagtgctgaagctactcttaagtacaatgttgcaatcaagtgtgccaccattactccagatgaggctcgtatgaaggagtttactttgaagagcatgtggaagagtccaaatggtaccatcaggaacattttgaacggcacggtttttagngaaccaatnatgtgcaaaaacattccaaaactgataccaggntggacaaagccaatatgcatnggaagacatgcttttggtgatcagtacaaagctactgatgcagtgattaaaggccctgggaaactgaanatggtatttgttcctgaaggacaaggggaanangtagatntggaggtttacaacttcacgggtgctggaggggtagctttgtcaatgtacaacactgatgagtccattaccgcttttgctgaggcctcgatgaacacagcctacttgaaaaantggccactttatctaagcacaaagaataccattctaaagaagtatgatggaaggttcaaggacatattccaagaagtttatgaacgcaactnggaatcnaagttcgaggctgctgggatatggtatgaacaccgtctcattgatgatatggttgcttatgctcttaagagcgatggaggctatgtatgggcatgcaaaaactatgatggggatgtgcaaagtgatttcttagctcaaggtttnggatcacttgggctaatgacgtcggtcctggtgtgtcctgatgggaaaaccattgaagctgaagcggcccatggcaccgtgacacgtcattacagggtgcaccaaaagggaggtgaaactagcacaaacagcatagcctccatttttgcttggacccgaggacttgctcacagggcaaagttggatgacaatgctaagctcttggatttcactgaaaagttagaagcagcttgtgttggttgcgttgaatccggcaagatgaccaaggatcttgctttaatccttcatggatccgagctgagtagggaacactacttgaacaccgaagaattcattgatgctgtggccgatgatctgaaagcaagactctccgccaattagtcaacataacaagggttggttggatggaaataagaaagaaaggagagatttgattgaggatatttttattcttaatttgatttgttatgaattgctacaattactacttggtagggtcttattcgccaattagttccggatttattggctcgagtttaaacctaccggaagaaggtgttgtaatatgcttttggacttttggtgcacgttttactagtaatcttttgaaaaaagatgggtc

SEQ ID NO: 1648 - DNA, 1452 bp, Centaurea maculosa
  misc_feature (107)..(107): n is a, c, g, or t
  misc_feature (152)..(152): n is a, c, g, or t
  misc_feature (301)..(301): n is a, c, g, or t
  misc_feature (521)..(521): n is a, c, g, or t
  misc_feature (851)..(851): n is a, c, g, or t
  misc_feature (863)..(863): n is a, c, g, or t
  misc_feature (1181)..(1181): n is a, c, g, or t
  misc_feature (1190)..(1190): n is a, c, g, or t
  misc_feature (1197)..(1197): n is a, c, g, or t
  misc_feature (1202)..(1202): n is a, c, g, or t
cttggcggggacaccccactgtcgtctcgctccttctcctttgccatttccttcgaacatactttctctccgatcggctggaaaatatggctttcgataagatcaangttacaaaccccatcgttgagatggacggagatgaaatgactcgngtcttttggcaatcgataaaagataagctcatcttcccctttgttgaactggacataaagtattacgaccttggccttcctaatcgtgatgctaccgatgacaaagtcaccgtagaaagtgctgaagccactctcaagtacaatgttgnaatcaagtgtgccaccatcactccagatgaggctcgtatgaaggagtttaccttgaaaagcatgtggaagagtccaaatgggacaatccgaaatattttgaacggcactgtttttagagaaccaattctttgcaaaaacattcccaagctagttccaggatggacaaagccgatatgcatcggaagacatgcatttggtgatcagtacaaagctactgangccgtgattaaaggacctgggaagctgaagatggtgtttgttcctgaaggagaaggtgaaacaacggagttggaggtttacaacttcaccggtgctggaggggtagctttgtcaatgtacaacactgatgagtccattcgtgcttttgccgaggcctcaatgaaccaagcttatgagaaaaagtggccactttatcttagcacaaagaatactattcttaagaaatatgatggaagattcaaggacatattccaagaagtctacgagagcaactggaagtcaaagtttgaggctgccgggatatggtatgaacaccgtctcattgatganatggttgcatangctctcaagagcgatggaggttacgtatgggcatgcaagaactacgatggtgatgttcaaagtgatatgttagcacaagggttcggatctcttggattgatgacgtcagtcctggtgtgtcctgatggaaagaccattgaagccgaagcagcccatggcactgtaacccgtcactacagggtgcaccaaaagggtggggaaaccagcacaaatagcatagcctcaatctttgcatggacccgagggcttgcccacagggcaaagttggataacaactctaagcttttggaattcactgagaagctggaagcagcatgnattggaacngttgaanctggnaaaatgacaaaggatcttgcactcattcttcatggatccaagctgagtagggagcactatttgaacacagaagaattcatcgacgctgtagcaaccgagctgaaagcaagacttattggcaaatcatcattgtaaggtgacagttgagggtgatgatacatgaggaagatttatatggtatggttgtgtttaatcgtccttcatttgtgcactctatttctggtttgattgaattcggggaagcaacaca

SEQ ID NO: 1649 - DNA, 1566 bp, Castanea mollissima
gtttggtagtttgaagacagtgttccagacaaggctgaagaacaacatcaacgcacaacaaacgacatcatcatctattacaatttacaaatgggattccagaagattaaggtggccaaccccatcgtcgaaatggatggagatgaaatgactcgaatcttttggaaatcaatcaaagacaagcttatatttccctttgtggagttggatatcaagtactttgatcttggtctcactaatcgtgatgccaccaatgataatgttacaattgaaagtgctcaagccactcttaggtacaatgtagcaataaagtgtgcaactataactccagatgaagctcgtgtcaaggagttcaaattgaaacaaatgtggaagagtccaaatgggacaattcggaatattttaaatggtactgttttcagagagcctattatctgcaaaaacatcccccgtcttgtcccaggttggacaaagccaatatgcattggaaggcatgcttttggtgatcagtacagggcaactgatattgttatacaagaatctggaaaacttaaattggtatttgtacccaatggacataatgagaagaaagagtttgaggttttcaactttacaggtgctggaggtgtagccttgtccatgtacaacactgatgagtctattcgtgcttttgctgaggcttcaatgaatactgcttaccagaaaaagtggccactttatcttagcactaaaaataccattcttaagaaatatgatggaagattcaaggacatatttcaggaagtttatgaaactcaatggaaatctaagtatgaagctgcagggatatggtgagatatcaaactatcatgctaattagtttatacagtttgagaagcttgtcatcaacttacagctgcagggatatggtatgaacaccgtctcatagatgatatggttgcttatgccatgaaaagtgaaggaggttatgtatgggcttgcaaaaactatgatggggatgtgcagagtgatttcttagcccaaggatttggatctcttgggatgatgacatcagtgctggtgtgcccagatggaaagactattgaatctgaagcagcccatggaacagtgacccgccactatcgggtccatcagaaaggtggtgaaaccagcacaaacagcatagcatccatttttgcttggactcgaggtcttgcacacagggcaaagttggacagcaatgctagacttttggattttactgagaaattggaagcagcctgtgttggaacagtggaatcaggaaagatgactaaggatcttgcacttcttattcatgggcccaaggttactaggtcgcagtatctaaataccgaagagttcattgatgctgtagccgaggagctgagagcaagactgactacaagggcaaagttgtaaagaaatgccaccaacttggctttatgcttggaaataaggttgcagtatgcttccactcataagcggcatcaatttctgagtttatattatttttttggtctctcaatttattctatcaatcctcttaactctcactgaatgttggag

SEQ ID NO: 1650 - DNA, 1473 bp, Castanea mollissima
ctttgtctcaatctctctctttcttttataaaaaatggcgttcgagaagatcaaggtggcgaaccccatcgttgagatggacggagatgaaatgaccagagttttctggaaatcaataaaggataagcttattttcccctttctggacttggacattaagtactttgaccttggccttccttatcgtgatgccactgatgataaagttacaattgaaagtgcagaagctactcttaagtacaatgtagcaatcaagtgtgcaactattactccagatgaagctcgcgtgaaggagtttggcttgaagcagatgtggaagagtccaaatgggacaattaggaatattctgaatggtactgtcttcagagaaccaattatttgcaaaaacgttcctcgccttgtcccaggctggaccaagcctatatgtatcggaagacatgcttttggtgatcaatatcgcgcaactgatactgtaattaagggagctgggaaactgaaactggtgtttgtaccagaaggaaaagatgagaagacagagttagaggtttacaactttacaggtgctggaggagtggcaatagcaatgtataacactgatgagtccatccgtgcctttgctgaggcttccatgaacactgcctatcagaaaaagtggccactgtatctaagcacaaagaatactattcttaagaagtatgatggaagattcaaggacatatttcaagaagtctacgaggcaaactggaaatcaaagtatgaagctgcaggcatatggtatgaacaccgtcttatcgatgatatggttgcttatgctgtcaagagtgaaggaggttatgtctgggcatgcaagaactatgatggtgacgtgcagagtgatttcttagcccaaggttttggatctcttggattgatgacatcagtactggtttgtccagatggaaagaccatagaagcagaagccgcacatggtactgttacacggcattttagggttcatcagaaaggaggtgaaaccagcacgaacagcatagcctcaatctttgcttggtcccgagggctgtcacacagggcaaagctggatgacaatgctaagctattggatttcactgagaaactagaagcagcttgtgttggaaccgtggaatctgggaagatgaccaaggatcttgcgcttcttatccatggatctaaggttactagggagcagtatctgagtactgaagagttcattgatgctgttgcaacagaacttaaagcaaggctttctgcctaagcatagatgaatggctaggcgacccgaagcatggaagtctttttggtgaacttcatatgatattgaggagcaataaagaaattggggggttgagcgtgaacgtttttggagtattgatgggttgagttttagggtgctaattctgactgctctaacagacagctctcatcctctgcttatctgtaactccctattttcat

SEQ ID NO: 1651 - DNA, 1529 bp, Cichorium intybus
gcggggatcaactctctatcactgtctcacagtcgtctcgctctttctcacttcggttgccgacccgccgatctccgatcatcctttactaggaaatggctttcaacaagatcaaggttgaaaaccccatcgttgagatggacggagatgaaatgactcgcatcttttggcaatcaatcaaagataagctcatcttccccttcctagatcttgacattaagtattatgaccttgggcttcctaatcgtgatgcaactgatgataaagttactgtagaaagtgctgaagctactctcaagtacaatgttgcaatcaagtgtgccactattactccagatgaggctcgtatgaaggagtttaccttgaaaagcatgtggaagagtcccaatggcacaatccgtaatattttgaatggcacggtttttagagaaccaattctttgcaaaaacatccctaggctaattccaggatggacaaagcctatatgcattggaagacatgcatttggtgatcaatacaaagctactgatgcagtcattaaaggacctggaaaattgaagttggtatttgttcctgaaggagaaggtgaaaatatagacctggaggtttataaattcactggtgcaggaggggtagctttgtcaatgtacaacactgatgagtcgattgctgcttttgctgaggcctcaatgaacacagcttatcagaaaaaatggccactttatcttagcaccaaaaacaccatcctgaaaaaatatgatggaagattcaaggacatatttcaagaagtctacgaaagcaactggaagtcaaagtttgaagctgctggtatatggtatgaacaccgtttgattgatgacatggttgcttatgctctcaaaagtgatggagggtatgtttgggcatgcaaaaattatgatggtgatgttcaaagtgatttcttagctcaaggttttggatctcttggattgatgacatcagttttggtgtgtcctgatgggaagactattgaagctgaggcagcccatggcacagtgacacgtcattacagagtgcatcaaaagggaggggaaacaagcacaaacagcatagcctcaatctttgcatggacacgtggcctggcccacagggcaaaattagataacaactctaaacttttggatttcactgagaaactagaagcagcatgtattggcactgttgaatctggaaagatgacaaaagatcttgcactcattcttcatggatccaagttgagtagggagcattatttaaacacggaggagtttattgatgctgtagcaaacgagctgaaagcgagacttgttgggaaatcatcgttgtgagtggaggaagatttaatgtcttttatctgaggacgtaatttgatctcaatttaattcttaagggaagtttaatgtttgcgagtatcatgaattggttatcttattattataatttgaagacttaatgattaatttttaatgttcggataatgtggttatgaagcgaataatttgtttcaaaaa

SEQ ID NO: 1652 - DNA, 1543 bp, Cichorium intybus
cttggcgggggccatctctttttcacagttgcttctttctctctgacttcggttgccggccggagtttctatattgccctcaaacgcacacacaaatctccgatcatctttcactatggcttttgagaagatcaaggttgcaaatcccatcgttgagatggacggagatgaaatgacacgcgtcttttgggaatcaatcaagaacaagctcatattccccttcctagagttggacataaagtactatgaccttggccttcttaaccgtgatgccacagatgataaagtcactgtagaaagtgctgaagctactcttaaatacaatgttgcaattaagtgtgccaccattactccagatgaggctcgtatgaaggagtttactttgaagagcatgtggaagagtccaaatgggaccatcagaaatatcttaaatggtacggtttttagggaaccaattttatgcaaaaacattcctaggttgattccagggtggacaaagccaatatgtattggaagacatgcttttggtgatcaatataaagctactgatgcagttattaaagggcctggaaaattgaagatggtatttgttccagaaggacaaggtgaaagtgtagacttggaggtttataacttcactggtgctggaggggtagctttgtcaatgtacaacactgatgagtccattacttcttttgctgaggcctcaatgaacactgcctacctcaaaaaatggccactctatttgagcacaaaaaataccatcctaaagaaatatgatggaaggttcaaggacatattccaagaagtttatgaaaagaactggaaatcaaaattcgaggctgctggaatatggtatgaacaccgtctcattgatgacatggttgcttatgctctcaagagtgatggaggttatgtatgggcatgcaaaaactatgatggagatgtgcaaagtgatttcttagctcaaggtttcggatcactcggactaatgacctcagttttggtgtgtcccgatggaaagaccatcgaagctgaagcagcccatggcaccgtgacacgtcattacagagtccaccagaagggaggcgaaactagcaccaatagcatcgcctcaattttcgcatggactcgtggacttgctcacagggcaaagttggatgacaactcgaggcttttggatttcaccgagaaattagaagcagcgtgtattggtacggttgaatctggcaagatgactaaggatcttgcactcattcttcatggatccaagctgagtagggagcactatttgaacaccgaagaattcatcgatgctgtagcagatgagctcaaaacaagactctccgccaaataatcgcataaatgtttaacgattgggactaatgcaaggtggtcgagattgaagggaatttgtgatgtgtatctggttggattcggtttgagcttatttatttttaatattgctacagacttatttggtaggttctatttgctaaattaatttcagattttttgtttttaatttacggctgattttctt

SEQ ID NO: 1653 - DNA, 1808 bp, Citrus sinensis
ccacgcgtccgttggttcttgagagagtcctggtcaaactcgaaagcagaagcatttcaattttcatagtattattattattattgcttcttgctgcttctttttgtccacacgacctcggcacctccgctctgaccctattatctctctctagttgtgaatcaaccgaaactgaacaaagaagaaaatggcttttcagaagatcaaggtcgccaatcccatcgtcgaaatggacggagatgaaatgactcgagttttctggaaatcgattaaggataagcttattttcccttttctggagttggacataaagtacttcgaccttggccttccgaatcgtgatgcaactgatgacaaagttaccgttgaaagtgcagaagccactctcaagtacaatgtagcgatcaagtgtgctactattactccagatgaagctcgtgttaaggaatttgtcttgaaacagatgtggaagagtccaaatgggacaatcaggaatattttgaatggcactgttttcagagaaccaatcatttgcaaaaatgtccctcggcttattccaggctggacaaagcccatatgcattggcaggcatgcttttggtgatcaatatcgagcaactgatacagttattcaaggacctggcaaacttaaattggtgtttgtaccagagggaaaagatgagaagacagagttagaggtttacaactttacgggtgagggtggagttgcattgtccatgtataacactgatgagtccatccgagcttttgctgaggcttctatgaacactgcctatcagaagaagtggccactctatcttagtacaaaaaacactatccttaagaagtatgatggaagattcaaagacatatttcaagaggtttatgaggcaaactggaagtcaaagtttgaagctgctggcatatggtatgaacatcgtctcattgatgatatggtagcttatgctctcaaaagtgaaggaggttacgtgtgggcttgcaaaaattatgatggagatgtccagagtgatttcctagctcaagggtttggatctcttggattgatgacatctgtactggtatgccctgatgggaagacaattgaagccgaagcagcccatggaacagtcacccgacactacagagttcatcagaaaggtggtgaaactagcacaaacagcatagcctccatctttgcttggtcacgagggcttgcacatagggcgaagttggacaacaatgctaggctattggattttactgagaaactagaagctgcatgtattggcactgttgaatctgggaagatgaccaaggatcttgcacttattatccatggatctaagatgactagggaacactatctgaatactgaagagttcattgatgctgtggccgacgatctaagagcaagactctctggcaaagcatgatttttttttaatgctacacattcaaaggtaaagacttggggaagcttcctttggttatctttttcatattatgctgagaagaaataattgaagaggggaaaattggggattgggatttggttctcttctaattgctacaatagactgctttcctgttgatcgacaaactctcattttcatgcaagcaaatgtcttgaacatggcttgttataaacaaaactattgctgccaaatttacgttcatggtttatttgagctgcacctctgttgccaaagttttaagatgtacgcacacaaaacctaattatttgcatttcatctcatgttgacatgctcgtatttttggataggctttggaacgaaacaattcctttgg

SEQ ID NO: 1654 - DNA, 1698 bp, Citrus sinensis
gcagagaaagcggagcgagaaagagaggcagagaaatggaattccagaagatcaaggtggccaatcccatcgttgaaatggacggtgatgaaatgactcgagttatttggaaactcatcaaggataagctaattaatccgtttctggagttggatatcaagtactttgaccttggccttcccaaccgtgatgccaccgacgatcaagttaccattcaaagcgctcaagctactctcaagtataacgtagctattaagtgtgcaactatcactccagatgaagtgcgggttaaggaatttaacttgaaaagaatgtggaagagtcctaatggaacaattcgcaacattctaaatggcacagtttttagagaaccgattatctgtaaaaacatccccaggctggtctcaggttggactaagccaatctgcattgggaggcatgcttttggtgatcagtatcgagcaactgatgctgttatacaagggcccgggaaacttaagttagtctttgttccagatggacttaatcagaagacagagtgggaggtctacagtttcactggtgctggaggcgtggctttatccatgtataacactgatgagtctgtccgttcttttgctgaggcttcaatgaacactgcttaccagaagaagtggccactctatcttagcacaaaaaacaccattcttaaaaattatgatggaagattcaaggatatatttcaggaagtctacaaagctcaatggaaatccaagttcgaggcagcagggatatggtatgaacatcgtctaattgatgatatggttgcttatgctctaaagagtgaaggaggttatgtatgggcatgcaaaaattatgatggggatgtgcagagtgatttcttagcccaaggatttggatctctggggctgatgacatcagtattggtgtgcccagatgggaagacgatcgaagccgaagctgcccatggtacagttacccgccattaccgggttcatcagaaaggaggtgaaaccagtacaaacagcatagcatcaatctttgcttggtcacaaggtcttgcacacagggcaaagttggatggtaatcccaggctattggattttactgagaaactggaagcagcctgcattgccacagttgaatcagggaagatgactaaggatcttgcacttcttattcatggacctcaggttgctaggcctcaatatctgaacactgaggagtttattgatgctgtaagtgagaccctgaaagagagaatgtctatcaaagcgaagttgtaaagtcctggcctcttacatggctttatgcttggacatttcgttggttcaacacaagtctgaataagagagtaactggtggacagattattgctgatattggaatgtcaataaaagagggaatgaacaagaattagtaactggttgagttttggttatacaacaaccctttcatggaacaagaattaaaatgttttgggtctaaggagaaaacattttaatctttatcttaaaatgtgagaacgatcgctgttgtattttctgtagtgtagaccatgaagatttctatgctcagctggggatgtttttatagttgtgctcagatcaatacaagataatgtgtttgtgcttcgtgaaattatgaagctatggtgctttgacattgcaccaagatcattatacgagtagttttgct

SEQ ID NO: 1655 - DNA, 1665 bp, Coffea canephora
  misc_feature (1227)..(1227): n is a, c, g, or t
gcccatcacccctcttcggctcatattcatttctccaactcagggtcccggatttctcgccggcggagattttctcgctaatctccgcttcccctgttccttgcgactcaaacccatcttatatatctagctctttcatcagataagctcgcaagaacaaaacaaagaaaatggcgttcgagaagatcaaggttgccaaccccatcgtcgagatggacggagatgaaatgaccagagtcatttggaaagcaatcaaggataagctcattctccctttcctggagttggatattaagtattttgaccttggacttcctcaccgtgatgccactgatgataaagttacagttgaaagtgcagaagctactctgaagtacaatgtggcaatcaagtgcgcaaccatcacacctgatgaagctcgtgtgaaggagtttggtttgaaggctatgtggaagagcccaaatggcacaatcaggaatattttgaatggcacggtctttagagagccaattctctgcaaaaatgttccccggcttgttccaggatggaacaagccaatatgcattggaaggcatgcatatggagatcaatacagagcaaccgatactgtgatcaaaggagctggaaagcttaaattggtgtttgtaccagaaggagccgatgaaaagaccgagctagaagtattcaactttactggtgcaggtggagtagctctatccatgtacaacacagatgagtctatccatgcttttgctgatgcctcaatgaacgttgcataccagaaaaaatggccactttatcttagcacaaaaaataccattctcaaaaaatatgatggaaggttcaaagacatattccaagaagtatatgaagccaactggaaatcaaagttcgaggctgctggaatatggtatgaacaccgtcttattgatgatatggttgcatatgctctaaagagtgaaggaggttatgtgtgggcttgcaagaattatgacggggatgttcagagtgatttcctagcacaagggtttggatcccttgggttgatgacatctgtcctggtatgtcctgatggaaagaccatagaagctgaagcagcccatggaactgttacacggcattacagggttcaccagaaaggaggtgaaactagcacaaacagcattgcctcgatctttgcttggacacgaggactcgcacacagggcaaagttggatgacaaccctngactgttggacttcactgagaaactggaggcagcatgcattggtactgttgagtcaggaaaaatgaccaaggatcttgcacttatcatccatggacctaagttaagcagagaacggtatttgaatactgaagagtttattgatgctgtggctgatgatctgagagcaagactctcctgcaaagcgtctctgtaggcaggttgatggatctgcttctctctgttctggattttgctgagaacaaataaaaaaggggaatgagaggaggctgttgggatggtggtcgcctgaatttgctcactcagtgagatgtattctggttgtcagtttaacatttatttccctaagctaaatgctttggacattgcaaatgtttcttggaggatgatttctcattacacatctataataaccttaatttatgccatgtctttctttt

SEQ ID NO: 1656 - DNA, 1659 bp, Gossypium hirsutum
gccgtcttaaagtcaccgatatacatctactcttcttctacttatactcaactttgtaagacacggcatccgcagtggctgctcatttttcatttttcatctaaatctctgatccgaaacaaaaaactcaaatcggtgggaatagcaatgggttttgagaagatcaaggtcgccaatcccatcgttgagatggacggagatgaaatgaccagagttatttggaaatcaattaaggataagctcattcttccctttgtggagttggacataaagtactttgaccttggtcttccacatcgtgatgctaccgatgacaaagttacaattgaaagtgcagaagctactcttaagtacaatgttgccatcaagtgtgctactattactccagatgaagctcgtgttaaggagtttgacttgaagcagatgtggaagagtcctaatgggactattaggaatattttgaacggcactgtctttagagaaccaattatttgcaaaaatgtccctcgacttgtcccaggttggacaaagcctatatgcattggaaggcatgccttcggtgatcagtaccgagcaactgatgctgtcattaaaggagctgggaaacttaaacttgtttttgttccagagggacagggtgagaagactgaatatgaagttttcaacttcactggtgaaggaggagtttcactggccatgtataacacagatgagtctattcgtgcttttgctgaggcttccatgaacactgcttatcagaagaagtggcctctttatcttagtacgaagaatactattcttaagaagtatgatggaagatttaaggatatctttcaagaggtttatgaggctaactggaaatcaaaatatgaggctgctgggatatggtatgaacaccgtctcattgatgatatggtggcatatgctctaaagagtgaaggtggttatgtttgggcatgcaagaactatgatggtgatgtccagagtgatttcttagcccaaggttttggatctcttggattgatgacatctgtgctggtttgcccagatgggaaaacaatagaagcagaagctgctcatggtactgttacacggcatttcagagttcaccaaaagggtggtgagaccagcacgaacagcatagcatctatctttgcttggacacgtgggcttgcacacagggcaaaattggatgacaatcctaaactcttagatttcattgagaaactagaggcagcttgtattgcaactgtggaatctggaaagatgaccaaagatcttgcactaatcattcacggctctaagcttgctagggacaagtacctgaatactgaggagttcattgatgctgttgcagcagatctaaaagcaagactttgttaagtataaatttgaacatggttgaaaatggaaggggatggttttgtgggtttgcaggaaaaataataataataaaaagcgtcagtggaggtggcgtggattaggtgaggagggcggtggggatggatgttgtcaatagatgaatttaatcaccattttatgaaatacagagacgagtactctctcacttgattcatctcatttttatgttttcaagggtttcgatttttaatgtaacattatatttaaggatttggattttggttaaatttccgtcgt

SEQ ID NO: 1657 - DNA, 1708 bp, Gossypium hirsutum
ggcacgagaaacattctgcgactgagttgacctattttttggaattgaatcatttgcctggacggtggccacataaggaaggcgtatgagaagctgaggttctgcagaatcaatatcctatgatctttatttcaaacctctgagaaggtgttggtgagtgggcgtttcaagtaaattcgaatcgacatggcattccctactaagataaaagtgatgaatccaatagttgagatggacggagatgaaatgactcgtattatttggaaatctataaaggaaaagctaatttttcccttcttggagttggatataaaatattttgaccttggtcttcataatcgtgatgccacgaatgatgaagttaccatcgctagtgccgaagctactcttaagtataatgtagcaattaaatgtgcaaccataactccagatgaaggtcgtgttaaggagttcaacttaaagaaaatgtggaaaagtccaaatgggactattcgaaacattttaaacggaactgttttcagggaaccaattatctgcaaaaatgtccctcggcttgtccctagttggaccaagccaatctgcatcggaagacatgcttttggcgatcaataccgagcaactgatttagttgtacaggaatctggaaaacttatgcttgtcttcgttcctgatacgagtaatgagaagaaggagcttgaggttttcaacttcaaaggtgctggtggtgtagctttgtcgatgtacaacactgatgagtctattcgtgcttttgctgaggcttcaatgactactgcttaccagaaaaaatggccactttatctaagcacaaaaaatacaattctaaagagttacgatggaagattcaaagacatattccacgaagtttatgaaacccaatggaaatcaaagtttgaggcagaaggtatttggtatgagcaccggcttattgatgatatggttgcttatgctctaaaaagcgaaggaggttatgtatgggcatgcaaaaactatgatggagatgtccagagtgacttcttagcccaagggtttggatcacttgggttgatgacatcagtgctgatgtgcccagatggaaagactattgaagctgaagcagcccatggcacagttacccgccactaccgtgttcataaaacaggaggtgaaaccagcactaacagcatagcatcaatttttgcttggtcacgaggccttgcacacagggcaaggttggatggcaatgatcgacttctagattttactcaaaaactggaagcagcctgtgttggaacagttgaatctgggaagatgacaaaagatcttgcgcttttgattcacggtcctaaggttagtaggtctcagtatctaaataccgaagagtttatcgaagcagtagccaaggagttgagtaacagaatgtatgtgaaaccaaagttgtaaagcatgcgtgtattgtgtgccctctcgtctaacttttagctttatttataattgccaataaataaggtctaatacatgtcctgcaatgcatgccagttatatagatttataaacaaataatgtattgaattctacataaacattataataagttgaagttcgggacactttatttgattgaaacaaataagtctcgattatgtttagagtgttatttgtcttttataaagtacctaatttcagtgaaatcaaagacgttgagttcatt

SEQ ID NO: 1658 - DNA, 1627 bp, Vigna unguiculata
gtaccgtaatagcagcaagtcacttgcttttgctaaactcttatctcttcacattattattcacttctcacctaaccttcttctctagtgctcttcttccagatcagaaactcagccatggcgttccagaagatcaccgtcgccaatcccatcgtcgagatggatggagatgaaatgactagggttatctggaaatcaatcaaggacaagctcattttgcctttcttggagttggacataaagtattatgaccttggtcttccataccgtgatcagaccgatgataaagttacaattgaaagcgcagaagctactctcaaatacaacgtagcaatcaaatgtgcaactatcactccagatgaagctcgtgtgaaggagtttggcctgaagaatatgtggaagagtccaaatgggacaattaggaacattttgaatggaactgtcttcagagaaccaattctttgcaaaaacattccgcgccttgttcctggttggacaaagccaatatgcatcggaagacatgcgtttggtgaccaatatcgggctactgacacagtaattaaaggagctggaaagctgaagctggtttttgttccagaaggcaaaggtgagaagactgaattagaggtttttgactttactggtcagggaggtgtttcattggctatgtacaatactgatgagtctattcgttcttttgccgaggcttctatggcaactgctttagagaaaaagtggccactttatcttagcaccaaaaatacaattcttaagaaatatgatggaagattcaaggacatatttcaggaagtttacgaggcaagctggaaatcaaagtttgaggctgctggtatatggtatgagcatcggctcattgatgatatggtggcttatgctcttaagagtgaaggaggttatgtatgggcatgcaaaaactatgatggtgatgtgcagagtgatttcttagctcaaggttttggatcattgggtttgatgacatctgtattggtttgccctgacggaaagactattgaagcagaagcagcccatggaacagttacccgtcattttagggttcatcagaaaggaggcgaaaccagcacaaatagcatagcatccatctttgcctggacaagagggctagctcacagggcaaaactggatgacaatgctaaactattggatttcactgaaaagctagaggcatcttgcattggagttgttgaggctgggaagatgaccaaggacttggcacttattattcatggatccaagctttcaagagagcactatttgaacacggaggagttcatcgatgccgtggcagccgatcttagaaagaagctttctgcatagacttgatttaaagacggacggaaagagactagaccaacaaggagcaaacatgtgccactgtactctgaagaaataagagaaagaagagaagcactgacccttgtgcttcatttgttggttgggaatgcaagggttgcttttcttctctgtattgtttgaactgctgatttgtcctttgtgattttgaactcatctcttccactttcctagttattatggattttgctgctattctgatgctttaatcttgcattttgtcttcttccgcata

SEQ ID NO: 1659 - DNA, 1524 bp, Cynara scolymus
tgtcgtctcgctctttctcacttaccatttctctcacacacagctctcccgatcgtcggaaatggctttcgataagatcaaggttacaaaccccatcgttgagatggacggagacgaaatgactcgcatcttttggcaatcgataaaagataagctcatctttcccttcgtagatctagacataaagtattatgaccttggccttcctaatcgtgatgcgactgatgataaagtcaccatagaaagtgccgaagcgaccctcaagtacaatgttgcaattaagtgtgccaccattactccagatgaggctcgaatgaaggagtttaccttgaaaagcatgtggaagagtccgaatgggacaatcaggaatatattgaacggcaccgtttttagagaaccaattctttgcaaaaacatccccaagctaattccaggatggacaaagccgatatgcatcggaaggcatgcatttggtgatcagtacaaagctactgatgcagttattaaaggacctgggaagctgaagatggtgtttgttcctgaaggagaaggtgaaaagacggagttggaggtttacaacttcactggtgctggaggggtagctttgtcaatgtacaacactgacgagtccattcgtgcttttgctgaggcctcaatgaacacagcttatgagaaaaagtggccactctatcttagcacaaagaataccattcttaagaaatatgatggaagattcaggacatatttcagaagtctatgagagcaactggaagtcaaagtttgaggctgctgggatatggtatgaacaccgtctcattgatgatatggttgcttatgctcttaagagtgatggaggttacgtatgggcatgcaaaaactatgatggtgatgtgcaaagtgatatgttagcacaagggttcggatctcttggattgatgacatcagtcttggtgtgtcctgatgggaagaccattgaagctgaggcagcccatggcactgtaacgcgtcactacagggtgcaccaaaagggaggggaaaccagcacaaatagcatagcctcaatctttgcttggacacgggggctcgcccacagggcaaagttagacaacaactctaagcttttggaattcactgagaagctggaagcagcatgtattggaactgttgaatctgggaaaatgacaaaggatcttgcactcattattcatggatccaagctgagtagggagcactatttgaacacggaagaatttatcgactctgtagcaagcgagctgaaagcaagacttgtgggcaaatcatcactgtaaggtgacagttgagagtaatggtacatgaggaagatttatgtggtatggttgtgtttaatcgtccttcatttgtgtactcttatctatttctggaattaggttctttgtttgattgaattcaggaaagctacacatagacatcaccatggttatgcttatggtcatttgaaggatttgtttcatatttttatcaaagggacctagtttcatcgaa

SEQ ID NO: 1660 - DNA, 1691 bp, Cynara scolymus
  misc_feature (1567)..(1567): n is a, c, g, or t
  misc_feature (1573)..(1573): n is a, c, g, or t
  misc_feature (1641)..(1641): n is a, c, g, or t
gcggggcatccattttcgcagttgctactctctctttctctcacttcggttgccggccggagtttctccatcttccttttacgaacacacaaatctccgatcatccttcagtatcaatcaattggaaatggctttcgagaagatcaaagttgcaaatcccatcgttgagatggacggagatgaaatgactcgcgtcttttgggaatcaattaagaataagctcatctttcccttcgtagaccttgacataaagtattatgaccttggccttcttaatcgtgatgccaccgatgataaagttaccatagaaagtgctgaagctactcttaagtacaatgttgcaattaagtgtgccaccattactccagatgaggctcgtatgaaggagtttactttgaagagcatgtggaagagtccaaatgggaccatccgaaacattttgaatggcacggttttcagggaaccaattctatgcaaaaacatcccgagactgataccaggatggacaaagccaatatgcataggaagacatgcttttggtgatcaatacaaagctactgatgcagtgattaaaggacctggaaaactgaagatggtatttgttcctgaaggacaaggtgaaaacatagatttggaggtttataacttcactggtgctggaggggtagcgttgtcaatgtacaacactgatgagtccattacttcttttgccgaggcctcgatgaacacagcctacctgaaaaagtggccactttatctaagcacaaagaataccatcctaaagaagtatgatggaaggttcaaggacatattccaagaagtttatgaaagcaactggaaatcgaagtttgaggctgctgggatatggtatgaacaccgcctcattgatgatatggttgcttatgctcttaagagcgatggaggttatgtatgggcatgcaaaaactatgatggggatgtgcaaagtgatttcttagcgcaaggttttggatcacttggactcatgacatcggtcctggtgtgtcctgatgggaaaacaatcgaagccgaagcagcccatggcaccgtgacacgtcactacagggtgcaccaaaagggaggggaaactagcacaaacagcatagcttcaattttcgcttggacccgaggacttgcccacagggcaaagttggatgacaacgctaagcttttggatttcaccgaaaagttagaagcagcttgtattggttgcgttgaatctggcaagatgaccaaggatcttgctctaatcatccacggatccaagctcagtagggaacactacttgaacaccgaagaattcattgatgctgtagcagatgagctgaaagcaagactctcagccaaataaataatgagtgtatgtatgatgaattgatttttagcatcaatcagagtagagatgcacaaggccggtttcaatcgggcttcttcgattattagatcaataatgaacatggaaatgccatcattatttttgttaaatcacttgtattttgagccggaacagccctctttgtccgcttcttctagaccctatctatctatntatctntgacgtgatatactgggtttatttggattatatatttgaattttgataattgatatcaaatcatcttnaaacaaaaaaaaaaagggccgctcggccagtcgactctgactcgagcagc

SEQ ID NO: 1661 - DNA, 1541 bp, Taraxacum officinale
  misc_feature (339)..(339): n is a, c, g, or t
  misc_feature (433)..(433): n is a, c, g, or t
  misc_feature (865)..(865): n is a, c, g, or t
  misc_feature (1300)..(1300): n is a, c, g, or t
ctcgcggggatttagattgcgatacacgtatattgggtcaggcggccgccgttaataaaggtcacttttcccttgcttcccataccaactctccatcattgtctcacagtcgtctcgctttttctcacttcggttgccggccaaatatctccgatcatctgtaggaaatggctttcaacaagatcaaggttgaaaaccccatcgttgagatggacggagatgaaatgactcgcatcttttggcaatcaatcaagataagctcatcttccccttcctagatcttgacataaagtattatgaccttggccttcctaatcgtgatgccactgatgataaagncacagtagaaagtgcagaagctactctcaaatacaatgttgcaattaaatgtgccactattaccccagatgaggcacgtatgaaggagttcacnttaaaaagcatgtggaagagtcccaatggcacaatccgtaatattttaaatggcacggtttttagagaaccaattctttgcaaaaacatcccaagactaattccagggtggacaaagcctatatgcattggaagacatgcatttggtgatcaatacaaggctactgatgcagttattaaaggacctgggaaactgaagttggtttttgttcctgaaggagaaggtgaaaagctagacttagaggtttacaacttcactggggctggaggggtagctcagtcaatgtacaacactgatgagtcgattactgcttttgctgaggcctcaatgaacacagcttatgagaaaaagtggcctctttatcttagcaccaagaacactatcctcaaaaaatatgatggaagatttaaggacatattccaacaagtatangagagcaactggaagtcaaagtttgatgctgctgggatatggtatgaacaccgtttgattgatgacatggttgcttatgctctcaagagtgatggagggtacgtatgggcatgtaaaaactatgatggagatgttcaaagtgatatgttagcacaaggtttcggatctcttggattgatgacatcagttttggtgtgtccagatggaaaaaccattgaatctgaagcagcccatgggacagtgacacgtcattacagggtgcatcaaaagggtggtgaaacaagcacaaacagcatagcctcaatctttgcatggacccgaggcctggcccacagggcaaagttggataacaattctaagcttttggattttactgagaaactggaggcagcgtgtattgggactgttgaatctgggaagatgacaaaggatctngcactcatcattcatggatcaaagctgagtagggaacattatttgaacactgaagaatttattgatgctgttgcaaatgagctgaaagcaaggcttgtggggaaatcatcactgtaagtggaaggatggttgagacttgagagaaatggcagatgaagatttatgtgggatgcttttaagaactttttttttatttgatcaatttcatgattaagggatatttaaagattattatctcgct

SEQ ID NO: 1662 - DNA, 1618 bp, Eucalyptus gunnii
ggcagcactgttcaccgctgagctctcgtttcgccctgtccctatctccgtctcgctctctctctgcaaaagagctccctcgaatcgacctgcttcgacccttcctcgagcgcgggagagagcaatgggtttcgagaagatcaaggtcgagaaccccatcgtcgagatggacggggatgaaatgacccgagtgttctggaaatcaatcaaggataagcttatttttcccttcttggagttggatatcaagtacttcgaccttggtcttcctcatcgtgatgccactgatgacaaggttacaattgaaagcgcagaagcaactcttaaatacaatgtggccatcaaatgtgcaactattacaccagatgaagctcggatgaaggagtttactttgaagcaaatgtggaaaagtcccaatgggacgattaggaacatcttgaatggcactgtcttcagagagccaataatgtgcaaaaatattccccggcttgtcccagggtggtccaagccaatatgcattggaagacatgcttttggtgatcaatacaaagctactgatactgtcattaaaggagctgggaaacttaaacttgtctttgtgccagaaggcacagatgagaagactgagctagaagtgtataacttcacgggcgctggtggagttgcattgtccatgtacaacacagatgagtcaatccgttcttttgctgaggcttcaatgaacactgcttatcagaagaagtggccgctctatcttagcacaaagaataccatccttaaaaaatatgatggaagattcaaggatatattccaagaagtttatgaagccaactggaagtcaaagtttgaggctgctggaatctggtatgaacaccgtcttattgatgatatggtggcttatgcgctaaagagcgacggaggttatgtgtgggcatgcaagaactatgatggagatgtccagagtgatttcttagcccaagggtttggatcgcttggcttgatgacatctgtcttggtctgcccagacggaaaaactattgaagcagaagccgctcatggtacggttacccgccattatcgggtccatcagaaaggaggcgaaaccagcactaatagcattgcttctatatttgcttggtcacgagggcttgctcatagggccaagttggataacaatgccaaactccttgattttgccgagaaactagaagcagcttgtattggaactgttgagtctggcaagatgaccaaggatcttgcactcctcattcatggtcctaagtttactagggatcaatacctgaacaccgaagagtttattgatgctgtggcagctgaactcaaggcaaggctttcatgccaaagtctgctgtaggtgactggcggacaacatggggaaagcacttccgcctgtgattgtgatccggaagaagaagaaataaagggggatcgattcgggggagaatgaggtgaatcctgaatgagattgtttgttggggaggaattaaatgaaagtagttcgtatcattcatgtactcagatggatttgtgtttcaaatttgaattgccttgatcccccgttaaaggagttttgagccccgtactgtttaacatcttg

SEQ ID NO: 1663 - DNA, 1412 bp, Festuca arundinacea
  misc_feature (31)..(31): n is a, c, g, or t
  misc_feature (1155)..(1155): n is a, c, g, or t
  misc_feature (1222)..(1222): n is a, c, g, or t
  misc_feature (1228)..(1228): n is a, c, g, or t
  misc_feature (1231)..(1231): n is a, c, g, or t
  misc_feature (1285)..(1285): n is a, c, g, or t
  misc_feature (1327)..(1327): n is a, c, g, or t
  misc_feature (1329)..(1329): n is a, c, g, or t
  misc_feature (1335)..(1335): n is a, c, g, or t
  misc_feature (1346)..(1346): n is a, c, g, or t
  misc_feature (1354)..(1354): n is a, c, g, or t
  misc_feature (1376)..(1376): n is a, c, g, or t
ggcacgaggcctccccgtgccgccgtcctcngccccacctgccccgttcccgatctcccaggcaagcagctccgccgcggccgccatggcgttcgagaagatcaaggtcgccaaccccatcgtcgagatggacggcgatgagatgaccagagtgttctggcagtctatcaaggacaagcttatcttcccattcttggacttggacatcaagtactacgacctgggagttctgcaccgtgatgcaaccgatgacaaggtcacggtggaggctgcagaggccactctcaagtacaatgtggctattaagtgtgcaactattactccagacgaagatcgggttaaggagttcaacctaaaacaaatgtggaggagcccaaatggcacaattaggaacattataaacggtactgtgttcagagaaccaattatttgcaagaatgttccaaagcttgttccaggatggaccaagcccatttgcattggaaggcatgccttcggtgatcagtaccgagcaactgatgcagttcttaagggacctggcaaactcagactagttttcgaggggaaagacgagacagttgacctggaggttttcaacttcacgggtgctggaggagtggccttggctatgtacaacacagatgagtcaattcaaggtttcgctgcggcttctatggcaattgcctatgagaagaaatggccattgtaccttagcacaaaaaacacaatccttaagaaatatgatggcaggttcaaggacatattccaggcgatctatgaagctgactggaaatccaaatttgaggctgccggaatatggtatgaacatcgtctcattgatgacatggttgcctatgcacttaagagcgaaggaggctatgtttgggcttgcaagaactacgacggagatgtgcagagtgatttcttagcacaaggttttggctctttgggcttgatgacatcagtattgatgtgccctgatggtaaaaccatcgaagctgaagctgcccatggcacagttacccgtcatttccgtgttcaccagaaaggtggtgaaaccagcacaaacagcattgcttcaatctttgcttggacaagaggacttgcgcacagggcaaagctagatgacaatgctaggcttcttgatttcacacngaaacttgaggaagcatgtgtcggaactgttgagtcagggaagatgacgaaggatctagcgcttctngttcanggntcttcaaaggtcacaagaggcgattacctgaacactgaagagttcattgacgcngttgctgcggagctccaatcaaggctggcagccaactgaacntncaaganaacctcgtccncaccagtncttcaatagtcattgcccaacnattcaagtcattttggttatgtcgcaattatctgtc

SEQ ID NO: 1664 - DNA, 1602 bp, Festuca arundinacea
  misc_feature (1535)..(1538): n is a, c, g, or t
ggcacgaggctccgacctggtcttcaaatgcgctggcaaagttggtcactccgttctctctcctccccgtgccgccgtcctccgcccacctgccacgccccgccccgctccgttcccgatctccgaggcgcagctccgccgcggccgccatggcgttcgagaagatcaaggtcgccaaccccatcgtcgagatggacggcgatgagatgaccagagtattctggcagtctatcaaggacaagcttatcttcccattcttggacttggacatcaagtactacgacctgggagttctgcaccgtgatgcaactgatgacaaggtcacagtggaggctgcagaggctactctcaagtacaatgtggctattaagtgtgcaactattactccagatgaagatcgggttaaggagttcaacctaaaacaaatgtggaggagcccaaatggcacaattaggaacattataaacggtactgtgttcagagagccaattatatgcaagaatgttccaaagcttgttccaggatggactaagcccatttgcattggaaggcatgccttcggtgatcagtaccgagcaactgatgcagttctcaagggacctggcaaactcagactagttttcgaggggaaagacgagacggttgatctggaggttttcaacttcaccggtgctggaggagttgccttggctatgtacaacacagatgagtcaattcaaggtttcgctgccgcttctatggcaattgcctatgagaagaaatggccattgtaccttagcacgaaaaatacaatccttaagaaatatgatggcaggttcaaggacatattccaggcgatctatgaagctgactggaaatccaaatttgaggctgccggaatatggtatgaacatcgtctcattgatgacatggttgcctatgcacttaagagtgaaggaggctatgtttgggcttgcaagaactacgacggagatgtgcagagcgatttcttagctcaaggttttggctctttgggcttgatgacatcagtattgatgtgcccggatggtaaaaccatcgaagctgaagctgcccatggcacagttacccgtcatttccgtgttcaccagaaaggtggtgaaaccagcacaaacagcattgcttcaatctttgcttggacaagaggactcgcacacagggcaaagctagatgacaatgctaggcttcttgatttcacacagaaacttgaggatgcatgtgtcggaactgtggagtcagggaagatgacgaaggatctagcacttcttgttcatggatcttcaaaggtcacaagaggcgattacctgaacactgaagagttcattgacgcagttgctgcggagctccaatcaagactggcagccaactgaactttcaagaaaacctcgttcacaccagtgcttcaatagtcatcacccaacgattcaagtcattttggttatgtcgccattatctgtcatgatttcttcctgaacagaatgagcttttactgcaccatcgcaaattattgtcgaaannnnatcaatgctgtagatgctgatgttatgtaagtggagctcaaaataaaggactgattgttcacct

SEQ ID NO: 1665 - DNA, 1612 bp, Zingiber officinale
ctctctctctaactccgctccgtctcttctctctgcctcgtccaactccgcccgatctgttggccgtgcgtctagagatggcgtacgagaagatcaaggtcgccaaccccatcgttgagatggacggggatgaaatgacccgagtcttttggaattcgattaaagaaaagctcatttttccattcttggacttggatatcaagtattttgatttgggcttacctcaccgtgatgccacagatgataaagtcacaatagagagcgcagaagccacccttaaatacaatgtagctatcaaatgtgcaacaattactccggatgaagctcgagttaaggagttcaacttgaaatcaatgtggaagagccctaacgggacaattagaaatattttgaatggaactgtatttagagagccaattatttgcaaaaatattccacggcttgttccaggatggacaaagccaatatgcattggaagacatgcttttggtgatcaatacagggcgactgatacagtcattaaaggacctggcaagctcaaattaatttttgaaggaaaagaagaggaagttgaactcgaggtgtacaacttcactggagcaggcggagttgccttatcgatgtacaatactgatgagtcaattcgctcatttgctgaagcttccatggctactgctttacaaaagaaatggccactttatctcagcactaagaatacaattttgaagaaatatgatggaaggttcaaagatatattccaagaggtttatgaaactgaatggaaatccaagtttgaggctgcagggatttggtatgaacaccgtctcattgatgacatggttgcatatgcactcaagagtgaaggtggttatgtttgggcttgcaaaaactatgatggagatgtgcagagtgatttcttagctcaaggttttgggtctcttggtctgatgacatcagtgctggtgtgtccagacggaaagaccatcgaagctgaagctgcacatggaacagttacacgccattaccgtgttcatcagaagggtggtgaaactagtacaaacagtatcgcctccatctttgcctggtcaagagggcttgctcacagggcaaagttagatgacaacgccagactgcttgatttcaccgaaaagctggaagctgcttgtgttggaactgttgaatctgggaagatgaccaaagatctagcgcttctcattcatggatcccgcgtcactcgagaaaagtatctgaacaccgaagagttcattgatgcggtggcatctgagctgagagctaagctttcttcgtaaatccctttgcggccagcacagttattcacttggccatgaggctgaatttgcaagttcctgaagctggggttggggaaggttcgctacttagttacttcaaataaaaattgcttgtgttgggaagaaacattttccattcatcatttcttcatagtccatggattgtttgtgaacatttggtactgcaacttatcattgatggtgcttcatccatagttcgacttgaacatttctctagataaattctaaattttttattttattgtgttttattattagagaaattgaaattatatttgttt

SEQ ID NO: 1666 - DNA, 1551 bp, Vitis vinifera
aagtttcttcacaccgcaggcattgcaattgcctctgcctctcaatatcttctctctccctgcttggtatcacttgcaaaatctacagagagagagaaaaatggccttcgacaagatcaaagtcgccaaccccatcgttgagatggatggagatgaaatgactcgagttttctggaaatcaatcaaggataagcttatttttccatttctggagttggatataaagtattttgatcttgggctccctcatcgtgacgccactgatgataaggttacagttgaaagtgcagaagctacacttaagtacaatgtagcaatcaagtgtgcaactattactccagatgaaggtcgcatgaaggaattcgacttgaagcaaatgtggaagagtccaaatgggacaattaggaatatattgaatggcaccgttttcagagaaccaatcatttgcaaaaacattcccaggcttgtcccaagttggacaaagccaatatgcattggaaggcatgcttttggtgatcagtatcgagcaactgatacagtgattaaaggagctgggaaactcaaattggtgtttgtaccagaaggaaaagatgaaaagacagagcttgaggttttcaactttacaggtgctggaggagtagcattgtcgatgtataatactgatgagtccatttatgcttttgctgaggcttcaatgaacactgcttacctaaaacagtggcccctttatcttagcacaaaaaatactattcttaagaagtatgatgggagattcaaggacatattccaagaagtttatgagacccaatggaaatcaaagtatgaggctgctgggatctggtatgaacaccgtctcattgatgatatggttgcttatgctctcaagagtgaaggaggttatgtgtgggcatgcaagaactatgatggagatgtacagagtgatttcttagctcaaggattcggatctcttggtttgatgacatctgtgctggtttgtccagatggaaagaccatagaagctgaagctgcccatgggacagtgacacgtcatttccgggttcatcagaaaggaggtgaaaccagtacaaacagcatagcctctatctttgcttggtcacgaggccttgcacacagggcaaagttggatgacaatgctagactcttggatttcactgagaaactagaagcagcttgtgttggaactgtggaatctggaaagatgaccaaggatcttgcacttcttatccatggatctaaggtgacgagggattggtatctgaatactgaagagttcatcgatgctgtggcagcagagctgacagcaaaactttcttgctaagcataattggtggtttacacctttgagttcaagactgaataggtttctcatgtactctggccgatggctaagaagaaataaaggggagagagggacaaagaggcgtgggaaggagtttagttgtgtttgtacttgaaaatttaatatttcggacaatcctcatacttgaatttctctgatctttcattttggataaaaatgtttttgtggta

SEQ ID NO: 1667 - DNA, 1619 bp, Actinidia deliciosa
  misc_feature (115)..(115): n is a, c, g, or t
  misc_feature (117)..(117): n is a, c, g, or t
  misc_feature (163)..(163): n is a, c, g, or t
  misc_feature (269)..(269): n is a, c, g, or t
  misc_feature (344)..(344): n is a, c, g, or t
  misc_feature (722)..(722): n is a, c, g, or t
  misc_feature (1477)..(1477): n is a, c, g, or t
ctcttcttgtctctgcagtctctcgactctctcccacaaagacaatattactctctctctctctctctctcttcgccactgctcgccggcggaggcattcacaaatctttctctntntatctatatataagctactatcatacttaaagagagagaaaatggngttcgagaagatcaaggtcgccaatcccatcgttgagatggacggagatgagatgactcgagtcttttggaaatcaataaaggagaagcttattttcccctttctngagttggatattaagtactttgaccttggccttcctcaccgggatgccactgatgataaagttactattgaaagngccgaagctactcttaagtacaatgtggcaatcaagtgtgcaaccattactccagatgaagctcgtgtggaggagtttaaattgaagcagatgtggaagagtcctaatggaacaattaggaacattctgaatggaaccgtcttcagagaaccaattatttgcaaaaatgtcccccgcctcatcccaggatggacaaagcctatatgcattggaagacatgcatttggggatcaatatagagcaactgacgcggtcatcaaaggacctggaaaactcaaactggtgtttgtgccagaaggaaaagatgaaaagacagagttggaggtttacaattttactggtgctggaggagtagcattgtctatgtacaatactgangagtccatctatgcttttgcggaggcttcaatgaacaccgcttaccagaaaaagtggccgctttatcttagcacaaagaatactattcttaagaaatatgatggaagattcaaggacatatttcaggaagtgtatgaaaccagctggaagtcaaagtatgaggctgctgggatatggtatgaacatcgtctcattgacgatatggttgcttatgctcttaagagtgatggaggctatgtatgggcatgcaaaaactatgatggggacgtgcagagtgatttcttggcacaagggtttggatctcttgggttgatgacgtctatcctggtgtgccctgacggaaagaccatagaagcagaagcagctcatggcactgttacacggcattacagggttcaccagaaaggtggtgagaccagcacaaacagtatagcctcaatctttgcatggtcccgagggcttgcacacagagcaaagttggacaacaacgctagactgttggatttcactgaaaaactagaagcagcctgtgttggaactgtggagtctgggaagatgactaaggatcttgcacttataaaccatggacctaagcttagtagagatctgtatctgaatactgaagagttcattgatgctgtggcgaatgagcttagaggaagacttggttgcaaagcataattgtcatgtaattgatttaaagactgcaattgggttttctagtgcggttttgttgagaagaataaagaggtgcnacagaagattcaggcagtcttgcaaggttggggactgttgtggaatagtggtttctaattgttatcaaggacatttgttatatgaatctgataatctgatatgctacttcagtttgcatttattatcttgaaataaatttgt

SEQ ID NO: 1668 - DNA, 1557 bp, Actinidia deliciosa
cacattagtagtgccacacacaacactctctctctctgtccaactgctcgccggcggagagaaaatggcgttcgagaagatcaaggtcgtcaatcccatcgttgagatggacggagatgagatgactcgcatcttttggaaatcaataaaggagaagcttattttcccctttctggagttggatattaagtactttgaccttggccttcctcatcgggatgccactgatgataaagttactgttgaaagtgccgaagctactcttaagtacaatgtggcaatcaagtgtgcaactattactccagatgaaggtcgtgtggaggagtttaaattgaagcagatgtggaagagtcctaatggaacaattaggaacattcttaatggaactgtcttcagagaaccaattatttgcaaaaatgtcccccgcctcatcccaggctggaccaaacctatatgcattggaagacatgcatttggggatcaatacagagcaactgacgcagtcatcaaaggacctggaaaactgaaactggtgtttgtgccagaaggaaaagatgaaaagacagagttggaggtttacaattttactggtgctggaggagtagcattgtctatgtacaatactgacgagtctatctacgcttttgcggaggcttcaatgaacactgcttaccagaaaaagtggccactttatcttagcacaaagaatactattcttaagaaatatgatggaagattcaaggacatatttcaggaagtgtatgaaaccagctggaagtcaaagtatgaggctgctgggatatggtatgaacaccgtctcattgacgatatggttgcttatgctcttaagagtgatggaggctatgtatgggcatgcaaaaactatgatggggacgtgcagagtgacttcttagcacaagggtttggatctcttgggttgatgacatctgtcctggtgtgccctgatggtaagaccatagaagcagaagcagctcatggcactgttacacggcattacagggttcaccagaaaggtggtgagaccagcacgaacagtatagcgtcaatctttgcatggtcccgagggcttgcacacagagcaaagttggatgacaatgctcgactcttggatttcactgaaaaactagaagcagcctgtgttggaactgtggagtctgggaagatgactaaggatcttgcacttataagccacggatctaagcttagtagagatctgtatttgaatactgaagagttcattgatgctgtggcaaatgagcttagaggaagacttggttgcaaagcataattgtcatgtaattgatttaaaggctgcaattgggttttctagtgaatcgaggttttgttgagaagaataaagaggtgcaacagaagattcaggcagtcttgcaaggctggggactgttggggaatagtggtttctaattgttatcaaggacatttgttatatgaatctgataatttgatatgctacttcagtttgcatttatcatcttgaaataaatttgtaccctgtttttactttaaaaaaaaaaa

SEQ ID NO: 1669 - DNA, 1456 bp, Actinidia deliciosa
  misc_feature (11)..(11): n is a, c, g, or t
  misc_feature (431)..(431): n is a, c, g, or t
  misc_feature (476)..(476): n is a, c, g, or t
  misc_feature (545)..(545): n is a, c, g, or t
  misc_feature (624)..(624): n is a, c, g, or t
tctctctctcnatatttctgtattgtatgcacgtatagagagagaaaatggcgttcgagaagatcaaggtcgctaatcccattgttgagatggatggagatgagatgactcgagtcttttggaagtcaataaaggataagcttattttcccctttctggagttggatataaagtactttgaccttggccttccttatcgtgatgccactgatgataaagttactattgaaagcgcagaagctactcttaagtacaatgtggcaattaagtgtgcaaccattactccagatgaagctcgtgtgaaggagttcaatttgaagcagatgtggaagagtcctaatgggacaattaggaacattctgaatggcactgtcttcagagaaccaattatttgcaaaaacgtcccccggctcatcccaggatggacaaancctatatgcattggaaggcatgcattcggagatcaatacagagcnactgatgcagtaatccaaggacctggaaaactcaaattggtgtttgtaccagaaggaaaagatgaaaanacagagttggaggtttataattttaccggtgctggaggagtagctttgtccatgtacaacactgatgagtccatttatncttttgctgaggcctcaatgaccactgcttatcagaaaaagtggcctctttatcttagcacaaagaataccattcttaagaaatatgatggaagattcaaagacatatttcaggacgtgtatgaaaccaagtggaagtcaaagtatgaggctgccgggatatggtatgaacaccgtctcattgacgatatggttgcttatgctctcaagagcgacggaggttatgtatgggcatgcaaaaactatgatggtgatgtgcagagtgatttcttagcacaagggtttggatctcttggtttgatgacgtctgtcctggtgtgccctgatgggaaaactatagaagctgaagcagcccatggcactgttacgcgccattacagggttcaccagaaaggtggtgaaaccagcaccaacagcatagcctcgatatttgcatggtcccggggccttgcacacagggcaaagttggataacaatgctagactcttggatttcactgagaaacttgaagcagcttgtattggagctgtggaatccgggaagatgaccaaggatcttgcgcttataatccatggatcgaagcttactagaggccaatatctgaatactgaagagttcattgatgctgtggcagatgagctgcgagcaagattttctttcaaaacgaaattgtagagcgatttaaagagtgcaaaagcattttcgagtgattcgggatctcgcttagaagataaaggagtgcaagagaacatttgggcagcaaaaatatttgtgtacgactcgtataatcttaatttgatatgctacttcattttgcatttgtcatcttgaaa

SEQ ID NO: 1670 - DNA, 1579 bp, Lactuca sativa
tttcacagttgcttctttctctctcacttcggttgccggccggagtttttatatcgccgccttacgcacacacatatctccgatcatctttcaatctcagtcaataagaaatggcttttgagaagatcaaggttgcaaaccccatcgtggagatggacggagatgaaatgacccgtatcttttgggaatcaatcaagaataagctcatctttccctttctagatttggacataaagtactatgaccttggccttctcaaccgtgatgccacagatgataaagtcactgtagaaagtgctgaagctactcttaagtacaatgttgcaatcaagtgtgccaccattactccagatgaggctcgtatgcaggagttcactttgaagagcatgtggaagagtccaaatggaaccataaggaacattttgaatggaactgtttttagggaaccaattctttgcaaaaacatccctaggttgattccagggtggacaaaaccaatatgcattggaagacatgcttttggtgatcagtataaagctactgatgcagtgattaaaggacctgggaaattgaaaatggtgtttgttcctgaaggtcaaggtgaaaccatagatttggaggtttataacttcactggtgctggaggggtagctttgtcaatgtacaacactgatgagtccattacttcttttgctgaagcctcaatgaacactgcctaccttaaaaagtggccactttatctaagcacaaagaacaccattctaaagaaatatgatggaaggttcaaggacatattccaagcagtttatgaaagtaactggaaatcaaagtttgaggctgctgggatatggtatgaacatcgtctcattgatgacatggttgcttatgctcttaagagtgatggagggtatgtttgggcatgcaaaaattatgatggagatgtccaaagtgatatgttagctcaaggttttggatcgcttggactaatgacttcagtcctggtgtgtcctgatgggaagaccattgaatctgaagcagcccatggcactgtgacacgtcattacagggtgcaccagaagggcggtgaaaccagcacaaatagcattgcctcaatttttgcttggacccgaggtctcgcccacagggcaaagttggatgacaactccaagcttttggatttcacggaaaagttagaagcagcgtgtattggatgcgttgaatctggcaagatgactaaggatcttgctctcattattcatggatccaagctgagtagggagcactatttgaacaccgaagaattcattgatgctgtggcactcgaactcaaaacaagactctctgcctaataatcaccatgaatgccttgacaattgagactaatgcatggtggtaacaagagaagattggtaattctgttatgagggttggatgggagtttgtgatgtgtatttggttggattatatttgaacatctttatttttaattttgttctacgaaatatttggtagggtttatctgctaagttaatttcagattttatttgttttaattcatggttgatcttttagaaaagaa

SEQ ID NO: 1671 - DNA, 1446 bp, Leymus cinereus x Leymus triticoides
  misc_feature (439)..(439): n is a, c, g, or t
  misc_feature (523)..(523): n is a, c, g, or t
  misc_feature (535)..(535): n is a, c, g, or t
  misc_feature (539)..(539): n is a, c, g, or t
  misc_feature (583)..(583): n is a, c, g, or t
  misc_feature (1162)..(1162): n is a, c, g, or t
  misc_feature (1169)..(1169): n is a, c, g, or t
  misc_feature (1198)..(1198): n is a, c, g, or t
  misc_feature (1222)..(1222): n is a, c, g, or t
catggcgttcgagaagatcaaggtcgccaaccccatcgtcgagatggacggcgatgagatgaccagagtattctggcagtctatcaaggacaagcttatcttcccatttttggacttggacattaagtactttgacttgggagttctgcaccgcgatgcaactgatgacaaggttacagtggaggctgcagaggctactctcaagtacaatgtggctattaagtgtgcaactattactccagatgaagatcgggttaaggagttcaacctaaaacaaatgtggaggagcccaaatggcacaattaggaacattataaacggcaccgtgttcagagagccaattatatgcaagaatgtcccaaagcttgttccaggatggactaagcccatctgcattggaaggcatgctttcggtgatcagtaccgagcaactgatgcngttctcaagggacctggcaaactcagactagttttcgagggaaaagacgagacggttgacctcgaggtttttaacttcactggngctggaggagtngccntggctatgtacaacacagatgagtcaattcgaggttttgctgcngcttctatggcaattgcttatgagaagaaatggccgttgtaccttagcacaaaaaacacaatccttaagaaatatgatggcaggttcaaggacattttccaggagatctatgaagctgactggaaatccaaatatgaggctgctggaatatggtatgaacatcgtctcattgatgacatggttgcctatgcacttaagagcgaaggaggctatgtttgggcttgcaagaactatgacggagatgtgcagagtgatttcttagctcaaggttttggctctttgggcttgatgacgtcagtattgatgtgccctgatggtaaaaccatcgaagctgaagctgcccatggcacagttacccgccatttccgtgttcaccagaaaggtggtgaaaccagcacaaacagcattgcttcaatctttgcttggacaaggggacttgcacacagggcaaagctagatgacaatgcccgacttcttgaatttgcacaaaaacttgaggatgcatgcgtcggaactgtggaatctgggaagatgaccaaggaccttgcactccttgttcatggatcttcaaaagttacnagaagcnattacctgaacactgaagagttcattgangcagttgctgctgagctcaaatcnagactgtaaaagacctcttccacttcaatgcttcaatagtcactactcatcgattcaagtcattttggttatgtcgccattatctgtcatgctttcatcctgaacagaacgagcttttactgcaccgtcgcatattattgtcaaaatgcaagcgattatgtagatgctgatggtatgtaagtggagctcacaataaaggacatagagaacgattattcacctca

SEQ ID NO: 1672 - DNA, 1568 bp, Liriodendron tulipifera
  misc_feature (38)..(38): n is a, c, g, or t
  misc_feature (941)..(941): n is a, c, g, or t
  misc_feature (962)..(962): n is a, c, g, or t
  misc_feature (968)..(968): n is a, c, g, or t
  misc_feature (974)..(974): n is a, c, g, or t
  misc_feature (992)..(992): n is a, c, g, or t
  misc_feature (1007)..(1007): n is a, c, g, or t
  misc_feature (1022)..(1022): n is a, c, g, or t
  misc_feature (1046)..(1046): n is a, c, g, or t
  misc_feature (1055)..(1055): n is a, c, g, or t
  misc_feature (1058)..(1058): n is a, c, g, or t
  misc_feature (1212)..(1212): n is a, c, g, or t
  misc_feature (1218)..(1218): n is a, c, g, or t
  misc_feature (1251)..(1251): n is a, c, g, or t
  misc_feature (1282)..(1282): n is a, c, g, or t
  misc_feature (1328)..(1328): n is a, c, g, or t
  misc_feature (1343)..(1343): n is a, c, g, or t
  misc_feature (1347)..(1347): n is a, c, g, or t
  misc_feature (1395)..(1395): n is a, c, g, or t
  misc_feature (1416)..(1416): n is a, c, g, or t
  misc_feature (1430)..(1430): n is a, c, g, or t
  misc_feature (1434)..(1434): n is a, c, g, or t
  misc_feature (1437)..(1437): n is a, c, g, or t
  misc_feature (1444)..(1444): n is a, c, g, or t
  misc_feature (1453)..(1453): n is a, c, g, or t
  misc_feature (1470)..(1470): n is a, c, g, or t
  misc_feature (1473)..(1473): n is a, c, g, or t
  misc_feature (1481)..(1481): n is a, c, g, or t
cctttcgctccttcaccggttcctccgatcctgctacngaaatggcgttcgagaagatcaaggtcacgaatcccatagtagagatggacggagatgaaatgactcgtgttttttggaaatcaatcaaggataagcttatattcccatttttggaattggatataaaatactttgaccttggtcttcctcatcgtgatgcttctgatgataaagtcacggtagaaagtgcagaggccactctgaagtataatgtggcaatcaaatgtgcaactataactccagacgaagctcgtatgacggagttcaacctgaaatccatgtggaagagtccaaatgggacaatcaggaatatcttaaatggtacggtctttagagaaccaattatctgcaaaaacgttcccaggctcattcccgggtggaataaacccatatgcattggaaggcatgcttttggtgatcaatacaaagcaactgatactgttatcaaaggccctggcaaactcaaattggtgtttgagggaaaagaagaagagattgaattagaggtgtataacttcacaggcgctggtggagtagccttatctatgtataatactgatgagtccatctatgcttttgctgaggcatcgatgaatacagcttatgagaagaagtggccactttatctaagcacaaaaaatacaattcttaagaaatatgatggaaggttcaaggacatattccaagaggtgtatgaaagtaaatggaaatccaagtttgaggctgcaggcatatggtacgaacatcggcttattgatgatatggttgcctatgcacttaaaagtgatggcggttatgtgtgggcgtgcaagaactacgatggagatgtacagagtgatttcttggctcaaggttttggatctcttggattgatgacatcagtactggtgtgccctgatggnaaaaccattgaagctgaagcngcacanggcacngttacacgtcattaccgngttcatcagaagggnggtgaaaccagtacnaatagcattgcttcaatctttgcntggtcacgnggncttgcacacagggcgaagttagataacaatgctagattgctggatttcactgagaaactggaggcagcttgcgttggaactgtggaatcagggaagatgaccaaagatcttgcacttatcattcatggatccaagattacccgagataagtatntcaatnctgaagagttcattgatgcagtggcagaggagntgaaagtgaggctgtccagcacatcaaagtngtaaaccccttgtcactcggattcacccagaaacattgttttggtntgagtaggggcaggngaangcatttgtggttttgtggtgtgttcagactgtagatttggaaagaaanaaaagagagcccagacctttntgccagcagtgatntttnatngatgtantgaagaacntcccttttttcagtttnttntgaatatntcattccctttgggtagaaactgtctttttgtgggaagttgtcaataatccctgtatttgtagacatgagttaatcacattagtcat

SEQ ID NO: 1673 - DNA, 1695 bp, Lotus japonicus
acactcttcctcgtgctctcgcttcactcctttctcacctacccttccttccttccttccttccatcgcagatcagattcacaaaccatggctttcgacaagatcaaggtcgccaaccccatcgttgagatggacggagatgaaatgactcgagttatctggaagtcaatcaaggataagctcattttgcccttcttggagctggacatcaagtactttgacttgggccttccttatcgtgatgagactgatgataaagttacagttgaaagtgcagaagcaactcttaaatataatgtagcaatcaagtgtgcaactatcactccagatgaagctcgtgtgaaggagtttggtctgaagcaaatgtggaggagtccaaatgggacaattaggaatattttgaatgggactgtcttcagagagccaattctttgcaaaaacgtccctcgccttgttcctggttggacaaaggcaatatgtattggaagacatgcttttggtgaccaatatcgggccactgaccaagtaattaaaggagctggaaagctgaagctggtttttgttccggaaggccaaggtgaggagactgaattggaggtttataacttcaccggtaaaggaggtgttgcattggctatgtacaacactgatgagtctattcgttcttttgctgaggcttccatggcaactgcttatgagaaaaaatggccactttatcttagcaccaaaaatacaattcttaagaaatatgatggaagattcaaggacatatttcaagaagtttatgaggcaggatggaaatcgaagtatgaggctgctggtatctggtatgagcatcggctcatagatgatatggtggcatatgcacttaagagtgaaggaggttatgtatgggcatgcaaaaactacgatggagatgtccagagtgatttcttagctcaaggttttggatcattgggtttgatgacatctgtactggtttgccctgatggaaagaccattgaagcagaagcagcccatggcacagttacccgtcattttagggttcatcagaagggtggggaaaccagcacaaacagcatagcatccatctttgcttggacaagagggctagctcacagggctaaactggatgacaatgctaaactctcggatttcactgacaagctagaggcagcttgcatcggagtagtagagtcagggaagatgaccaaggatttggcacttattcttcatggatccaagctttcaagggagcattatttgaacactgaggaattcatcgatgctgtggcagccgagctcaaggcaaagctttctgcgtaaaatgatgggtttagagtcatttcagacaggagagatagagcaaagctgaaaagggatcgtgtgcactgtcacaagaaataagaaagggaaaagaagcatctgtccttaaccccttttccctacattggtgtgttgggtgggaatactagggctttgctgcttccccatatttgtttgaactgattagtcttttgtaattttgaacctgagttgctacatttctgctgattttactttggatgttttgagttgttattacctgcataaatgcaaaggtagacataattccgagtaatgatttactcattaaaataagaattgcatagccggcaattatcgtacttataattgcaaattaatgattttgat

SEQ ID NO: 1674 - DNA, 1541 bp, Lotus japonicus
ttcctctttcacctcaatcaatcaacacagaagaaatggagtttcggaagataaaggttgacaaccccatcgtcgaaatggacggagatgaaatgacacgagtaatttggaaattgataaaagataagcttattttcccatttttggagctcgatattaagtattttgaccttggccttcctcatcgggatgccactaatgatagagttaccattgaaagtgctgaagctacactcaagtataatgtagctatcaagtgtgcaactataactccagatgaagctcgtgtcaaggagtttaacttgaaacaaatgtggaagagcccaaatgggacaattcgtaacattttaaatggtacagtttttagagaaccgattatctgcaaaaatgttcctcgtcttgtttcaggctggacaaagccaatatgcattggaagacatgcattcggtgaccaatatcgggcaactgatacaattataagaggaccaggaaagctaaaattggtgtttgaacctagtggacatgaagaaattaaagatctagaagtttataacttcgatggtgctggaggtgtagctttgtccatgtataatactgatgagtccattcaagcttttgctgaggcctcgatgaacattgcttaccagaaaaaatggcctctctatcttagcactaaaaataccattctcaagaaatatgatggaagattcaaggacattttccaggaagtttttgacacacaatggagtcaaaagttcaaagctgcagggatatggtatgaacaccgtcttatagatgatatggttgcgtattctcttaaaagtgatggaggttatgtatgggcctgcaagaattatgatggggatgtgcaaagtgatttcatagctcaaggatttggttctcttggcttgatgtcatcaatactggtttgtccagatgggaaaaccattgaatcagaggcagcccatggcactgttacccgtcattatcgagttcatcagaagggaggtgaaaccagcacaaacagtattgcttcaatttttgcctggtcgcgaggtcttgcacatagggcaaagttggatggaaatgctagattgtcggactttactgagaaactggaaacagcatgcattggaacagttgaattgggaaagatgacaaaggatctcgcgcttcttgttcatggacctaaggtttatagatcccagtatttcaatactgaagagttcattgatgccgtagcggatcagctgagaacaagattatctacacaagcgaagctataaagttcaagatgaatgtgtccaataaaaaataagctcaaaggtttccagctatcattttattgctaatgcctttggattaaaactatagattcatctttacccagagtttcaaattgttgttacatctgcggcgaagccagaatttttgtttaaaggagaccaagactaatgagtatattacttagtaaaaaattataaaatagcccatgcaaatttgatatatagctcttaatggagcctcaaattgcctgtttt

SEQ ID NO: 1675 - DNA, 1522 bp, Eragrostis curvula
  misc_feature (711)..(711): n is a, c, g, or t
  misc_feature (1267)..(1267): n is a, c, g, or t
  misc_feature (1294)..(1294): n is a, c, g, or t
  misc_feature (1317)..(1317): n is a, c, g, or t
  misc_feature (1333)..(1333): n is a, c, g, or t
  misc_feature (1338)..(1338): n is a, c, g, or t
  misc_feature (1351)..(1351): n is a, c, g, or t
  misc_feature (1353)..(1353): n is a, c, g, or t
  misc_feature (1355)..(1355): n is a, c, g, or t
  misc_feature (1370)..(1370): n is a, c, g, or t
  misc_feature (1375)..(1375): n is a, c, g, or t
  misc_feature (1393)..(1393): n is a, c, g, or t
  misc_feature (1427)..(1428): n is a, c, g, or t
  misc_feature (1430)..(1430): n is a, c, g, or t
  misc_feature (1432)..(1432): n is a, c, g, or t
  misc_feature (1434)..(1434): n is a, c, g, or t
  misc_feature (1452)..(1452): n is a, c, g, or t
  misc_feature (1480)..(1480): n is a, c, g, or t
ggggctcctgcccactcccttcccagccgccgccgtcgcctacccccgcctcgccgggcccttcccgatctccgaggcaagctgcgcggtgaccgccgccatggcgttcgacaagatcaaggtcgccaaccccatcgtcgagatggacggagatgagatgaccagggtattctggaagtccatcaaggacaagcttatcttcccgtttgtggaacttgacatcaagtactatgacttggggatcctgcaccgcgatgccaccgatgacaaggtcaccgtggaggctgcagaggccactctcaagtacaatgtggctattaagtgtgcgaccattactccagatgaaactagggtcaaggagttcaacttaaagcagatgtggaggagtcctaatggcacaattaggaacatcataaacggcactgtgttcagagagccaattatatgcaaaaatgttccaagacttgttccaggatggactaagcccatatgcattggaaggcatgcctttggagatcagtacagggcgactgatgctgtcctgaagggacctggcaagctcaagctagtttttgaggggaaagaagagcagattgatctggaggtgttcaatttcactggtgctggaggagttgccttgtctatgtacaacactgacgagtcaattagagctttcgctgaggcttctatgacaatggcctatgagaaganatggccgctataccttagcaccaaaaacacgattctgaagaaatatgatggcaggtttaaggacatcttccaggaggtttatgaagctgactggaaatccaaatatgaggctgctggaatatggtatgaacatcgtcttatcgatgacatggttgcctatgcgctgaagagtgaaggagcctacgtatgggcttgcaagaattatgatggagatgtgcagagtgacttcttggctcaaggttttggctctctgggtttgatgacatctgtattggtgtgccctgacggaaaaaccatcgaagctgaagctgcccatggcacagttacccgccatttccgtgttcaccagaaaggaggtgagaccagcacgaacagcattgcttccatctttgcttggacaagaggacttgcgcacagggcgaagcttgatgacaatgctaggctacttgactttgcgcaaaaactagaggctgcctgcattggaacggtggagtctgggaagatgacaaaagatcttgccctccttgttcatgggtcttccaaggttacaagaggngattatctgaacactgaagagttcatngacgcagttgctgccgagctccnatcaagactgtctgcnaattnagcttagaagaancncntggcaacttataatngtttnatcatttaggttatatcngcattgtcattctgtgcttccgtactgaagtgannancngnacaatttactgtcaacgngaactgattttaaagatgctgatgtatngtgtggctgctccaaataaaggacatagcaattgttcagtgc

SEQ ID NO: 1676 - DNA, 1644 bp, Zea mays
tgcccccctgttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaatgagtttggcttgaaggctatgtggaagagcccaaatggcacaattaggaatattctgaatggcactgtgttcagagaaccaatcatctgcaaaaacatcccacggcttgttccagggtggacaaaacccatttgcatcgggaggcatgcattcggtgatcagtaccgggcaactgatgcagttatcaaggggccagggaagcttaaattagtttttgagggaaaagaagagcaagttgagctggaggtgttcaacttcactggtgcaggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaaccagtacgaacagtattgcctcaatctttgcgtggacaagaggacttgcacacagggcaaagcttgatgacaatgctagactacttgacttcacccagaagcttgaggctgcctgcgttggagccgtcgagtctgggaagatgaccaaggaccttgcccttctcgttcacggatcttcaaatatcacgaggagccattacctgaacacggaggagttcattgacgctgttgctgatgagctcagatcaaggctggcagccaactcgaacctttgaaatccttgccgaagttgtggtgctttcctgcgcgacgctttcgaaccgtttttattatgtcgccattttctttccctgtgccaccaccctgatgaatgaagaaggcctgagctaggcgaacatctgcaggctgcagcagtatgccaaatcattatcattaccgttaccattaccaattggagattgccgtagatttccgcgattatgggaactcatttacctgattatctgatacgtttgaaataaaaggtcgcccattagaatga

SEQ ID NO: 1677 - DNA, 1566 bp, Zea mays
aaattcgctcgcatactctcttcctgtgtctgacatctctcttcctccttccacaagcgccgccgcagccccttctcgatctttgaggcaaagctacgactccaccaccgctggcatggcgttcgagaagatcaaggtctccaacccaatcgtcgagatggacggtgatgagatgaccagagtattctggcagtctatcaaggacaagcttatctttccatttctggacctggacatcaagtactatgacttggggatactgcaccgtgacgcaactgatgacaaggtcacagtggaggctgcagaggctactctcaagtacaatgtggccattaagtgtgcgaccattactccagatgaaactagggttaaggagttcaatttgaagcacatgtggaagagcccaaatggcacaattaggaacattataaatggtactgtgttcagagaaccaattatatgcaaaaacgttccaaggcttgttccaggatggacgaagcccatctgcattggaaggcatgccttcggtgatcagtaccgagctactgatgcagttctgaaggggcctgggaagctgaagctagtttttgagggaaaagaagaacagattgatctggaggtgttcaacttcactggtgctggaggagttgccttgtctatgtacaacactgatgagtcaattcgagcttttgccgcagcttctatgacaactgcatatgagaagaaatggccgctctaccttagcaccaaaaacacaatcctgaagaaatatgatggcaggtttaaggacattttccaggaggtctatgaagctgactggaaatccaaatttgaggctgctggaatatggtatgagcatcgtcttattgatgacatggttgcatatgcacttaagagtgaaggaggctacgtgtgggcttgcaagaattacgatggagatgtgcagagtgatttcttagcacaaggttttggctctttgggtttgatgacatcagtgttggtgtgccctgatgggaaaaccattgaagctgaagcagcccatggcacggttacccgccatttccgtgttcaccagaaaggaggtgaaaccagtacgaacagcattgcttcaatctttgcatggacaagggggcttgcacatagggcaaagctcgacgacaatgcgaggctcctcgacttcgctctcaaactcgaggccgcttgcgttggagctgtggagtctgggaagatgactaaagatctcgcacttcttgttcatggatcttccaaagtcacgagaagccattacctgaacacagaagagttcatcgatgcagtcgctactgagcttcgatcaagattgggagccaattgagctgacaggaaactctgcgttgcaacttgaatgcttcatcaccgatcggctctagtcatgcttccgtgattaagtgaatgtgcgccgccgcaatttcgagccaagctaattaaagatgatgggatcgcatcgcatgagcgttcaaaataaaggaatatgtagaacaatggtcgcagatgattaaattactcatattatgttcagtcattccc

SEQ ID NO: 1678 - DNA, 1570 bp, Zea mays
aataagcccgctcccacactcctttcttcccctgcctgccgtctctcttccaccttccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaagtgtgcgaccattactccagatgaaactcgggttaaggagttcaatctgaaacacatgtggaagagcccaaatggcacaattaggaacattataaatggcactgtgttcagagagcctattatatgcaaaaacgttccaagacttgttccaggatggactaagcccatctgcattggaaggcatgccttcggtgatcaataccgagctaccgatgcagttctgaaggggcctgggaagctgaagctagtttttgagggaaaagaagaacagattgatctggaggtattcaacttcactggtgctggaggagttgccttgtctatgtacaacaccgacgagtcaatccgagcttttgctgaggcttctatgacaactgcttatgagaagaaatggccactctaccttagcaccaaaaacacaatcctgaaaaaatatgatggcaggtttaaggacattttccaggaggtctatgaagctgactggaagtccaaatttgaggctgctggaatatggtatgagcatcgtcttattgatgacatggttgcgtacgcgcttaagagcgaaggaggctatgtgtgggcttgcaagaactacgatggagatgtgcagagtgatttcttagctcaaggttttgggtctttgggtttgatgacatcagtgttggtgtgccctgatggaaaaaccatcgaagctgaagctgcccatggcacggttacccgtcatttccgtgtccaccagaaaggaggcgaaaccagcacgaacagcattgcttcgatctttgcatggacaagaggacttgcccacagggcaaagctcgacgacaacgctagactactcgacttcgctctcaaactcgaggctgcttgcgttgagaccgtggagtccgggaagatgactaaagatcttgcgattcttgtccatggatcttccagcgtcacgagaagccattacctgaacaccgaggagttcatcgacgcagtcgctactgagctccgatcaagactgggagccaactgagcctacaagaaactttgcagggcgactttgaatgcttcgtcaccgtcaccgatctggtagtcgtcttttctgttatgaagaagtgaatgtgcgtcaccgcagtttcgatgcaagctaattatagatgtggtgtcacgtgagcgctcaaaataaaggatacacatgattaaattgtttttatgtcagtactaagctca

SEQ ID NO: 1679 - DNA, 1571 bp, Medicago truncatula
aaatagagtcgcggcataaacactttctcactctctaacatttctcatttctcaattctcacctaacctctctttctccgcatcgcttctgatcaccaccatgggattccagaaaatcaaagttgccaatcccatcgttgagatggacggagatgaaatgacccgtattatctggaagtatatcaaggataagctcattcttccctttgtggagttggacatcaagtactttgacctaggccttccctatcgtgatgagactgatgacaaagttacagttgaaagtgcagaagcaactctcaagtataatgtagcaatcaagtgtgcaactatcactccagatgaagctcgtgtcaaggagtttggtctgaagagtatgtggaggagtccaaatggaacaatcagaaacattttgaatggaactgtcttcagagaaccaattatttgcaaaaacatccctcgccttattcctggttggacaaagccaatatgtattggaaggcatgcttttggtgatcaatatcgggccactgactcagtgattaaagggccaggaaagctgaagctggtttttgttccagaaggccagggtgagaccaccgatttggaggtttataacttcaccggtgaaggaggtgttgcattggccatgtacaacactgacgagtctattcgttcttttgctgaagcgtctatggcagttgctcttgagaaaaaatggccactttatcttagcaccaaaaatacaattcttaagaaatatgatggaagattcaaggacatatttcaagaagtttatgaggcaggctggaaatcaaagtatgaggctgctggtatatggtatgagcaccggctcattgatgatatggtggcatatgcactcaagagtgaaggaggttatgtatgggcatgcaaaaactatgatggagatgtccagagtgatttcttagctcaaggttttggatcattgggtttgatgacttctgtattggtttgccctgatggaaagaccatagaagcagaagcagcccatgggacagttacccgtcatttcagggttcaccaaaagggtggagaaaccagcacaaacagcatagcatccatctttgcttggacaagaggtctagcccatagggcaaaactggatgacaatgctacgctcttggatttcactgaaaagctagaggcagcttgtattggagtagtagagtctgggaagatgaccaaggatttggcacttattcttcatggatccaagctgtctagggagcattatctgaacacagaggaattcatcgatgctgtggctgctgatcttaaaacaaagatctctgcttagatttgtgattttaggcagatgggaaaagggacgagattgaagggatcaaatggactttcaaaagaaataagaaaggggaacgaagcatggctacttttgcttcatttgtctgatggatgggaatgcaagggttgggttcttccccatattgtttgactgttttatttgtttgtaattttgaactaaatgccttagaagtttaaatgaattttcctttctttctgttgatttt

SEQ ID NO: 1680 - DNA, 1816 bp, Medicago truncatula
gtgaaaacaaacaagaaagtgttgaaacaaacgaaccaacaaagtacgaggttgggtctgatcccaacacaactaaacaaaactggtactgctgcaggcgttgaaaactgtgttcattacaaatggggtttcagaaaataagggttgataaccctatcgttgaaatggatggagatgaaatgacaagagtaatttggagaatgatcaaagataagcttattttcccatttctggagctggatattaagtattttgaccttggccttcctcatcgagatgccactaatgatagagttaccgttgaaagtggcgaagctaccctgaagtataacgtagctatcaaatgtgcaacaattactccagatgaaggccgtgtcaaggagtttaacctaaaacaaatgtggaagagcccaaatgggacaatccggaacatcttaaatggtacagtttttagagagccgattatctgtaaaaacattcctcgacttgtttcaggctggacgaagccaatatgcattggaagacatgcttttggagaccaatatcgggcaactgatgcagttataaaaggcccgggaaagctaaagttagtgtttgcacctagtggacatgaagaacctaaagagctagaggtgtataactttactggtgctggaggtgtaggcttggccatgtacaataccgatgagtctattcgagcgtttgccgaggcttcaatgaacattgctctcgagaaaaaatggcctctctatcttagcactaaaaacaccattctaaagaaatatgatggaagattcaaggatattttccaagaagtttatgacagcaaatggagtcacaagtttaaagctgcaggaatatggtatgaacaccgtcttatagatgacatggttgcgtatgctcttaaaagtgatgggggttatgtatgggcctgcaaaaattatgatggggatgtgcagagtgatttcatagctcaaggatttggttctcttggattgatgacatcaacactggtttgcccggatgggaaaactattgaagcagaggcagcccatggcactgttacccgtcattttcgggttcatcaaaagggaggtgaaaccagtactaacagtattgcttcaatttttgcctggtcgcaaggtcttgcacatagggcaaagttggatggaaacgctagactgttggacttcacggagaaactggaagcagcttgcattggaacagttgaattgggaaaaatgacaaaggatcttgcacttcttattcatggacccaaggtttctaggtcccactatttgaataccgaagagttcattgatgccgtagccgaggagctgagaacaagattaactacacaggcaaagctgtagagttccctagtttctcaggtttattatgtcaagttttgaatttggaatatgtttgtttgaataaaatatggaagaagttgggtggagagaataacaaggatgatgcagatacttgacagacacaacagacagaatcaagccaagggacaacacaaaccccatttgtgattacttaaaataagcacttcctaaacctggatttccccccttacagatagaaaaacttctgtttacaaagaattcattggcctggttgaacttcaacttattttggatttttcaagctctaaaaagggggctataaatgtaacaatatccccaaattgaggagctagctattctctatcttatgttctgttgttatagatatttttaaatatatttgtgaaaatgattacatgcattataaaaatttctgtcattttctatagaatatggaagtt

SEQ ID NO: 1681 - DNA, 1636 bp, Pennisetum glaucum
cgatctcccaggcaagctgcgacgccgcctccgcggccatggcgttcgagaagatcaaggtcgccaaccccatcgtcgagatggacggtgatgagatgaccagggtattctggcagtctatcaaggataagcttatcttcccatttttggacctggacatcaagtactatgacctgggtattctacaccgtgaagcaactgatgacaaggtcacagtagaggctgcagaggctactctcaagtacaatgtggctattaagtgtgctaccattactccagatgaaactcgggttaaggagttcaacctgaagcacatgtggaagagcccaaatggcacaattaggaacattataaatggcactgtcttcagagagccaattatatgcaaaaatgttccaaggcttgttccaggatggactaagcccatttgcattggaaggcatgccttcggtgatcagtaccgggctactgatgcagttctaaaggggcctgggaagctcaagctagtttttgagggaaaggaagagcagattgatctggaggtgttcaacttcactggtgctggaggagttgctttgtctatgtacaacactgatgagtcaattcgagcttttgccgaggcttctatgacaactgcttatgagaagaaatggccactctaccttagcaccaaaaacacaatcctgaagaaatacgatggcaggtttaaggacattttccaggaggtgtacgaagcagcttggaaatccaaattcgaggctgctggaatatggtacgagcatcgtctgattgatgacatggttgcgtacgcgcttaagagtgaaggaggctatgtgtgggcttgcaagaactatgatggagatgtgcagagtgatttcttggctcaaggttttggctcgctgggtttgatgacatcggtgttggtgtgccctgatggaaaaaccatcgaagctgaggctgctcatggcactgttacccgccatttccgtgttcaccagaaaggaggtgaaaccagcacgaacagcattgcttcaatctttgcttggacaagaggacttgcacacagggcaaagctcgacgacaatgctaggctactcgactttgcgctcaaactcgaggctgcctgcattggaactgtggagtctgggaagatgacaaaagatctggcacttcttgttcatggatctgccaacgtcacgagaagccattacttgaacactgaagagttcattgatgccgttgctgccgaactccaatcaagactggctgccaattgagcgtacatgaaattttggcaacttcaatgcttcatcaccaaccactcctaagtcatttcggttacatagccattgttattcatgcttctgatggagtgaatgcgccgctgcgccatttcgatgtaagctaattaaaattgcagtgttatgcacgctctcaaaataaaggacagaacgattggccagtgctatgattaggttgcctagaataagctccattatatttgtggaggtttaatttgtcttgcatgcttgtcttgtggataatcagttttttttccgattgcatttaggtggcattaacaacccttcacccttcaatcttgaaataaaaaaatcagatccatgtggcctgagtg

SEQ ID NO: 1682 - DNA, 1706 bp, Pennisetum glaucum
gccaaccccatcgtcgagatggacggcgatgagatgaccaggattttctggaaatctatcaaggacaagctgatcttcccgttcttggacttggacatcaaatacttcgaccttggacttccacaccgtgatgccactgatgacaaagttacagtggaggctgcagaggccacactcaagtacaatgtggctatcaagtgtgccaccatcacaccagatgaagcaagggtggaggagttcagcttgaaggccatgtggaagagcccgaatggcacaattaggaacatcctgaatggcactgtgttcagagaaccaatcatctgcaaaaacatcccacggcttgttccaggctggacaaagcccatttgcattgggaggcatgcattcggtgatcagtaccgggcaactgatgcagttatcaagggacctggcaagcttaaattagtttatgagggaaaagaagagcagattgagctggaggtgttcaactttactggtgctggaggagttgccttggcaatgtacaacactgatgagtccatccacgccttcgccgaggcttctatggccactgcttatgaaaagaaatggccgttgtaccttagcaccaagaacacaattttgaagaaatatgatggcaggttcaaggacattttccaggaggtatatgaagctgggtggaaatccaaatttgaggctgctggcatatggtatgagcaccgccttattgatgacatggtagcatacgcgcttaagagtgaaggagggtatgtttgggcttgcaagaattatgatggagatgtgcaaagcgatttcttagctcaaggttttggctcattgggtttgatgacatcagtattggtttgccctgatggaaagactatcgaagctgaagctgctcacggtactgttacccgtcattaccgtgttcaccagaaaggaggtgaaaccagtacaaacagcattgcctcaatctttgcgtggacaagaggacttgcacacagggcaaagcttgatgacaatgctagactacttgacttcactcagaagcttgaggctgcctgcattggagctgttgagtctgggaagatgaccaaggaccttgcccttcttgttcatggatcttcaaatgtcacaaggagccattacctgaacaccgaagagttcatcgacgcggttgctgatgagctcagatcaaggctggcagccaactcaaacttatagaatccttgatgcttccctgtccgatgatcagagtcattttccatacatcgtcattttctttcctggtgccaccaccctgaaggggcctgaactggatgtgaatatcttaagcagtatgccggatcattaccaacaagaaattgccctagattccgtgattatgggactcattcatatccccgattgcctgattatttcaataaatataaaagaacttctgtccgttcagaatgtgtggtggttgttttttctgcggaaaatttggatctatatcattaaaagattgcaactttatatatatcattgctatctcactagcatgtgggttcacatgagtcaatgacatgtgaggtcaatggtatatatcgaactttgtaatctttcaatagcatagatccattagtcctttttctgtacccagtttcgtgctcactgttggaaatcggaatggattctgccattctggcacttgtcgtgtagaa

SEQ ID NO: 1683 - DNA, 1653 bp, Mimulus guttatus
gaccctttcaaacctcaaaaagccccacttcacctactctcttcgttactgcagacgacggagatttttcttcacatcccccattaaatactctctctctctctctcttctggttcatctctctgtgcgaaaaaaaaagaggaaagagaaagaaatggcatttgaaaagatcaaggtggccaaccccatcgttgagatggacggagatgagatgacaagggtaatctggacatttatcaaagagaagttgattttccccttcgtggagctggatatcaagtactacgatctcggccttcctcaccgtgacgccacagacgataaagttaccgttgagagtgctgaagctactctcaaatacaatgtggcgattaagtgtgcgacgatcactccggatgaagctcgtatgacggagttcaacttgaagaatatgtggaagagtccaaatggtacaatcagaaatattttgaatggtacggttttcagagaaccaattctctgcaaaaatgttcctcgtcttgttccaggatggacgaagccgatttgcattggaaggcatgcctttggagatcaatacaaagcaaccgatgcagtaatcaaaggacctggaaagctcaaaatggttttcgtgccagaaggaaacggagagacaacagatttagaggtctacaatttcactggtgctggtggggttgctttgtctatgtacaacactgacgagtccatcaatgcttttgccgatgcttcgatgaacactgcctacgagaaaaaatggccgttgtatcttagcacaaagaacacaattctcaagaagtatgatggcagattcaaagacatattccaagaagtttacgaagctaaatggaaatcgaagtttgaggctgcaggaatatggtacgagcaccgtctaattgatgatatggttgcgtacgctctaaagagcgaaggaggctatgtatgggcttgcaagaactacgatggtgatgtgcagagtgatttcttagcacaagggtttggatctcttgggctgatgacctctgtcttggtttgccctgatggcaagacaattgaggccgaagctgcccatggaactgttactcgtcactttagggttcaccaaaaaggcggcgaaaccagtacaaatagcattgcctctatctttgcttggactcgtggcctcgcacacagggcaaagttggacgacaatgcaaaactattggaatttaccgagaaactagaagcagcttgtattggtgttgtggaatccggaaagatgaccaaggatcttgctctcatcatccatggatccaggctaaccagagagcactatctcaacactgaagagttcattgatgcggttgccgttgagctcaaagcaggactttcgtgctgagtataatcgatttcgaagacattttttctcttttataatccaatgaaatgcttttattatttacgcctttggagatctttcgtctcgaaaaactgctctactttttaaaaataattttatcttccattttattcggcttggattttattgcaaacacagagacatctgttacggcgtcgtatttacgagttaaatgattggaagaagcttgaccaatatccgatttacaaatattttgatttcttgttttttttctcggt

SEQ ID NO: 1684 - DNA, 1544 bp, Nicotiana benthamiana
  misc_feature (1150)..(1150): n is a, c, g, or t
  misc_feature (1222)..(1222): n is a, c, g, or t
  misc_feature (1231)..(1231): n is a, c, g, or t
  misc_feature (1317)..(1317): n is a, c, g, or t
  misc_feature (1364)..(1364): n is a, c, g, or t
tcaaacgctgggaaacccaaaaaaaaagagtaaggttgttaagaccgaattgaatattcattgtgctgtacccacaaaaatgtcctctttttttgtatttacgtcaatttcgcacttaccttcaaaaattcgacctttcgaaagtacactttctactcaatttccttactacaattcaaacatttttggccgacgaagctttctttaccaaactccatttatacccctttatttccacacttatcatatatcaccagaattttcagttcttaatctcaattctttacaagaaatggcttttcaaaagattaaagtggttaatcccatagttgaaatggacggagatgaaatgacccgtgtcatttggaaactaattaaggataagcttatctttccctttgtggagttggatataaaatacttcgatcttggtcttcctcaccgtgatgccacagatgataaggttacagttgaaagcgctgaggctactttgaagtataatgtagcaattaagtgtgcgaccatcactccagacgagggccgaatgaaggagtttaacttgaagcgtatgtggaagagcccaaacgggacaattaggaacattctgaatggtactgtgttcagggaaccaatcctttgcaaaaacgttccccgacttgtcccaggttggtcaaaaccaatatgcattggcagacatgcttttggtgatcaatatcgagctactgatacagtaattcaaggacctggaaaactaaaactagtgtttgtaccagaagggaaggatgaaaagatcgagttcgaggtttacaacttcactggtgctggtggagtagctctgtccatgtacaacacagatgagtctattcgctcttttgctgaagcttctatgaacatggcgtaccaaaagaaatggccgctctatcttagcacaaagaataccatccttaagaaatatgatggaagattcaaggacatattccaggaagtttatgagtcaaattggaaattaaagtttgaggaagctggaatctggtatgaacatcgcctcatcgatgatatggttgcttatgctttaaaaagtgatggtggttatgtatgggcatgcaaaaactatgacggggatgtacagagtgatttcttagcacaaggntttggatcccttggattgatgacatcgattctgatatgtccagatggaaagaccatagagtcagaagcagcncatggaacngtgacacggcactacagggtccatcagaaaggtggtgaaaccagcacgaacagcatcgcctcaatttttgcttggactcgtggacntgcacatagagcaaagttggacaacaatgctgcactcttggatttcnccaagaaactagaagcagcttgcatcggtgcggtggagaatggaaaaatgaccaaagatttagcacttatcgtccacggatccaaggttgctagacatcaatatgcgaacacagaagagttcatcgacgctgtggctgatgagctgaaagctagacttctgaaagcgaagatttaagcgt

SEQ ID NO: 1685 - DNA, 1628 bp, Elaeis guineensis
  misc_feature (1439)..(1439): n is a, c, g, or t
cgattgttttccccttcactcttcgttttgctgcttctcgcgagtcacgatctctctcccagagatggcgttggggaagatcaaggtcgcgaacccgatcgttgagatggacggggatgaaatgactcgggtcatctggaaatcaatcaaagataagcttatcttcccatttctggacttgaatatcaagtactttgacttgggacttcccaatcgtgatgctacaaatgacaaagtcacagttgaaagtgctgaagctactcttaagtataatgttgcaatcaaatgcgcaacaataactccagatgaaactcgtatgaaggagttcaacctaaaatctatgtggaggagtccaaatgggacgatcagaaacattttgaatggcactgtgttcagagagccaatcatctgcaaaaatgttccaaggctcgttccaggatggaccaaacccatatgcattggaagacatgcttttggtgaccagtaccgtgcaactgatacagttattaaaggacctggaaagctgaaattagtatttgaggggaaagaagagcaagctgagctagaggttttcaacttcactggtgctggtggagtggccttgtctatgtacaacacggacgagtccattcgtgcttttggtgaggcttcaatgaatatggcttaccagaaaaggtggccactttaccttagcaccaaaaatacgattctgaagaagtatgatggaaggtttaaagacatatttcaagaggtatatgaaactggttggaaatcaaagtatgaggctgcaggaatatggtatgaacatcgtctgattgatgatatggttgcctatgcacttaagagtgaaggtggttatgtatgggcttgcaagaactatgatggagacgtacagagtgatttcttagctcaaggttttggatctcttggattgatgacatcagtgctggtgtgccctgatgggaaaacaattgaagctgaggctgcacatggcacagtcacacgtcatttccgggttcaccaaaaaggaggtgaaactagtacaaatagcattgcttcaatctttgcctggtcacgtgggcttgcacacagggcgaagctagacaacaatggccagctgcttgatttcactgaaaaacttgaagcttcttgtataggaacagtggagtctggaaagatgactaaagacctagctcttctcatttatggatctaaggttactagagatcagtatctgaacacggaagagtttattgatgcagtggcagaagagctgagggcaagactttctcgcaaatcaaagttgtctgattaggctggagctgtggaataaaggattttgattatcatgttatgtggaggctatatatcttcggacaataattagtaaatctttttgttagccatcaactatattatggttccaaattcatagtccntcatgtgtgttgtgcttaaacttttagtacatgacacatttttatctcatttctgagcttaaatccactgcttggtttcatctttcacaaataattgatgcaccctcaaaattgaagagattgcattcatcttgtttactttagcattgactgagcttgtttataaggttctctctgtatcactattcc

SEQ ID NO: 1686 - DNA, 1712 bp, Arachis hypogaea
ctctttctcatttcccagctccagtaagtctcacactctcacctaccaagcctttcacgagtcatagatcggaaaagaaaaaattcaagctgccatgggatttgagaagatcaaggtcgacaaccccatcgtcgagatggacggtgatgaaatgaccagagttatctggaagtcaatcaaggataagctcattttgcccttcatggagttggacatcaagtattttgaccttggtcttccctaccgtgatcagactgatgataaagttacagttgagagtgcagaagcaactcttaagtataatgtagcaatcaagtgtgcaaccatcacgccagatgaggctcgagtgaaggaatttgacctcaagcaaatgtggaagagtccaaatgggacaattaggaacattttgaatggaactgtcttcagagaacccattctttgcaaaaacgtccctcgccttgttcctggctggacaaagccaatatgcattggaagacacgcatttggtgatcaatatagggccactgacacagttattaaaggagctgggaaattaaagctggtgtttgttccagaaagtggtgaaaagactgaactagaggtttttaacttcaccggtgaaggaggtgtttcaatggctatgtacaacactgatgagtctatccgtgcttttgctgagtcttctatggcaactgctcttgagaaaaaatggcctctttatcttagcaccaaaaacacaattcttaagaaatatgatggaagattcaaggacatattccaagaagtgtatgagaaaaactggaaatcaaagtatgaggctgctggtatatggtatgagcatcggctcattgatgatatggtggcgtatgcactcaagagtgaaggaggttacgtatgggcatgcaagaactatgatggagatgtccagagtgatttcttagctcaaggttttggatcattgggtttgatgacatctgtattggtttgccctgatgggaagactattgaagcagaagcagctcacggcacagtaacgcgtcactatagggttcatcagaaaggaggggaaaccagcacaaacagcatagcatccatctttgcttggactagagggcttgcccacagggcaaaattggataacaatgccagacttttggatttcactcaaaaactagaagcagcttgcattggagtagtggaggctgggaagatgaccaaggatttggcactcattattcatggacccaagctttcaagggagaattacctgaacaccgaggagttcatcgatgcagtggcagcggaactaaaagcacagctttctgcttagtccggttttagtttcagagacaggggataaaggacaaagctgaaaggagatcatatactctcttcagaagaaataagaagggcaagagtagcattggtcgtttgctccattttaacttcatatgcgctaggttggtggaatgaatggcttagctgcttccccatattgttttaactgatttgttatttgcaattttgaaccgatcccttctaagtttgaatggattttatgttcatgctgattttaatttgctgttcaaacttctcattctgtatctcatacggagtcattaaattgagtgttggaaaaattatcgagtttacattgcctacaatgttgaaaaaagatatacaaatacggtagatgaacaagtttttgttga

SEQ ID NO: 1687 - DNA, 1564 bp, Pisum sativum
aggatccgggtaccatggttctcacctaacatctcgttctccgcatcttcatcctcttctcttcttccgatcaccaccatggcattccagaaaatcaaagtcgccagtcccatcgttgagatggacggagatgaaatgacccgagttatctggaagtcaatcaaggataagctcatttttcctttcttggagttggacatcaagtactttgacctaggccttcctcatcgtgatcagactgatgataaagttacagttgaaagtgccgaagcaactctcaagtataatgttgcaatcaagtgtgcaactatcactccagatgaagctcgtgtcgaggagttcggcctgaagagcatgtggaggagtccaaatgggacaattagaaacattttgaatggaactgtcttcagagaaccaattatttgcaaaaatgtccctcgccttattcctggttggacaaagccaatatgtattggaaggcatgcttttggtgatcaatatagggccactgatgcagttattaaaggacctggaaagctgaagatggtgtttgttccagaaggcaaaggtgagaccactgatttggaggtttataacttcactggtgaaggaggtgttgcattggctatgtacaacactgatgagtctattcgttcttttgctgaggcatctatggcaactgctttagagaaaaaatggccactttatcttagcaccaaaaatacaattcttaagaaatatgatggaagattcaaggacatatttcaagaagtttacgaggcaagctggaaatcaaagtacgaggctgctggtatatggtatgagcatcgactcattgatgatatggtggcatatgcactcaagagtgaaggaggttatgtatgggcatgcaagaactatgatggagatgtccagagtgatttcttagctcaaggttttggatcgttgggtttgatgacatctgtattggtttgccctgatgggaagactattgaagcagaagcagcccatgggacagttacccgtcatttcagggttcatcaaaagggcggagaaaccagcacaaacagcatagcatccatctttgcttggacaagaggtctagcccatagggcaaagctagatgacaatgctaaactcttggaattcactgaaaagctagaggcagcttgtattggagcagtagaatctgggaagatgaccaaggatttggcacttattcttcatggatcccagcttaagagggagcattatttgaacacagaggaattcatcgatgctgtggcagccgagcttaaatcgaagatctctgcgtagatttgtgattttagatattagaaaagtgatgagattggagaggttcgcatgcactttcaaaagaaataagaaagaggattgaagcattggacttggctatttttctttccttcatttgtgtgttgggtcggatagcatgggttgtgcttccccccgtttagtttgaaattttgaattgggtacctttgaattttgacttacaaatttaaatggattttgttttgctatctctgctgaaaaaaaaaaa

SEQ ID NO: 1688 - DNA, 1571 bp, Capsicum annuum
tttgtaccaacttttctctcttcttcctcccacttctcatctaaaaatggcgtttcagaaaatcaacgttcaaaatcccatcgttgagatggacggagatgaaatgacgcgagttatttggaaatcaatcaaggataagctcatccttccctttctggagttggacatcaaatactttgaccttggacttccccaccgtgatttgacagacgataaggttacagttgaaagtgcggaagccactctaaagtacaacgtagctattaagtgtgcgaccattactccagatgaggcccgtgtaaaggagtttaagttgaaatccatgtggaggagcccaaatgggacaatcagaaacatccttaatggaacggtctttagagaaccaattatgtgcaaaaatattcctcgacttgtcccaggatggaccaaaccaatatgcatagggagacatgcttttggagatcaataccgagctactgatgcagttattcaaggagctggaaaactcaaattggtgtttgtgccagaaggatcagacgagaagactgaatacgaagtttacaattttactggtgctggtggagtagctttatccatgtacaacacagacgagtctattcgcgcatttgctgatgcttcaatgaacatggcataccaaaagaaatggccactctatcttagtacaaagaataccattcttaagaaatatgatgggaggttcaaggacatcttccaagaagtttatgaagcaagttggaagtccaagtacgaggaggctggaatctggtatgaacaccgtcttatcgatgatatggttgcttatgctttgaagagtgaaggtggttatgtatgggcctgcaagaactatgatggggatgtacagagtgatttcttagcacaaggttttggatcccttgggttgatgacatctgtcctggtctgtcctgatggcaagaccattgaggctgaagctgcccatggaactgttacccgccactacagggttcaccagaaaggaggtgagaccagcacaaacagcattgcctcgatctttgcctggactcgtggacttgcacacagggcaacattggacaagaatgaaaggctcttggatttcactgagaaactagaggccgcatgcattggtgcagtggaatctggaaagatgaccaaagatcttgcactcatcatccatggatccaagctgtcaagagagcattatctgaacacagaagagttcattgacgctgtggccgatgagctcaaagcaaaacttctgaaagcaaaggcctaaatgtctcggtagacaagaggacagtctttttctgtggcagtttgaggggatattttgaagagaaataaaaggagttagggactttgatggtatacttaaatttcaagaggggttttctcttgtaggttggggattactttgcaggcactgtaatatttgaactatttaaatttgaatttccatttggtgcaacttaattgctcatttgcaaatgtacacttagcttattgtttttcatcaatttgcttaaagaagttcagtagttgttgtttttcct

SEQ ID NO: 1689 - DNA, 1639 bp, Capsicum annuum
gcacgaggattttttatgtccaatttacccttacatagtagtagtaattatatttctccattttctagcaatttaatcttctctagcagaagaaattttctttatcaaacaccattaatctttatatcaccagaatttccacttcttaatttgaaattttcattaaatatggctttccaaaagatcaaagtggctaatcccatagttgaaatggatggagatgaaatgacccgtgtcatttggaaattaatcaaggataagctcatcttgccctttgtggagttggatataaaatacttcgatcttggccttcctcaccgtgatgccacagatgataaggttacaattgaaagcgctaaggctactttgaagtataatgtagcaattaagtgtgcaaccatcactccagatgaggctcgtatgaaggagtttaacttgaagcatatgtggaagagcccaaatgggacaattaggaatattctaaatggtacggtattcagggaaccaatcctctgcaaaaacatccctcgacttgtcccaggttggtcaaaaccgatatgcattggcagacatgcttttggtgatcaatatcgagctactgatacagtaattcaaggagctggaaaactcaaattagtatttgtaccagaagggacggatcaaaagaccgagtttgaggtttacaacttcactggtgctggtggagtagctctatccatgtacaacacggatgagtctattcgttctttcgctgaagcttctatgaacatggcgtaccaaaagaaatggccactctatcttagcacaaagaataccatccttaagaaatacgacggaagattcaaggacatattccaggaagtttatgagtccaactggaagttgaagtttgaagaagctgggatctggtacgaacatcgcctcatcgatgatatggttgcttatgctttaaaaagtgacggtggttatgtatgggcgtgcaaaaactatgatggagatgtacagagtgatttcttagcacaaggatttggatccctcggattgatgacctcgatcctgatatgtccggatggaaagaccgtggaagcagaagcagcccatggaactgttacacgacactacagggttcatcaaaaaggaggtgaaaccagcacgaacagcatcgcctcaatttttgcttggactcgtggacttgcacatagggcaatgttggacaacaatgctgcactcttagatttcaccaacaaactagaagcagcttgcatcggtgcagtggaaaacgggaaaatgaccaaagatctagcacttattatccacggatccaaggttgctagacaccaatatgtgaacactgaagatttcattgatgctgtggctgatgagctcaaagctagacttctgaaaccaaagatttaagctaaacttagggaggaagacagtttgcagtgtctttgaggatccatagataagatggcaaagtcacaccattcaacatgtgaatttactctttatactattctactccgtctccggccgctagaagaaaatatagaggacttctagtacttttttatatataaaattatcgttgtggatggtggcgatttatattatatagctgatctcaacttgtttggtt

SEQ ID NO: 1690 - DNA, 1660 bp, Petunia hybrida
cactcactagtgtcgtaggtagctgaccaactgccaataaatatttaatagagcagcctgcagagcacagttctacttcaccagctctcccttcacagttttctctgctcggccgagattaacatatctgccttcgatctctgaatttgcaaaaaatggcattcgaaaagatcaaagttgaaaaccccatcgttgagatggacggagatgaaatgacccgagttatttggaaatcaatcaaggataagctcatcttgccctttctcgagttggatataaagtactttgacctcggccttccccaccgtgatgccactgacgataaggttacagtagaaagtgcagaagccactcaaaagtataacgtagcaatcaagtgtgctactattactccagatgaggctcgtgtaaaggagtttaacttgaaatccatgtggaggagcccaaatgggacaattaggaacatcttaaatggaacggtctttagagaaccaattatgtgcaaaaatattccccgacttgtcccaggttggaccaaaccaatatgcattggtagacatgcttttggagatcaataccgagcgactgatacagttattaaaggagctggaaaactcaaattggtgtttgttccagaaggaacagatgataagactgaatttgaagtttacaactttactggtgctggtggagttgctttatccatgtacaacacagatgagtccgttcgctcatttgctgaggcttcaatgaacatggcatacataaagaaatggccactctatcttagtacgaagaatactattcttaagaaatatgatgggaggttcaaggacatcttccaagaagtttatgaagcaaattggaagtccaagtatgaggaagcaggaatttggtatgaacaccgtcttattgacgatatggttgcttatgctttaaagagtgaaggtggttatgtgtgggcctgcaagaactatgatggtgatgtacagagtgatttcttagcacaaggttttggatctcttgggttgatgacatctgtcctggtatgccctgacggcaagactattgaggctgaagcagcccatggaactgttacccgccactacagggttcaccagaaaggaggtgaaaccagcacaaacagcattgcctcaatctttgcctggactcgtggacttgcacacagggcaaagttggacagcaatgaaaggctgtctgattttactgagaaactagaggcggcatgtattggtgcagtagaatctggaaagatgaccaaagatcttgcactcatcatccacggatccaagctctcaagagagcattatctgaacactgaagagttcattgacgctgtggccgatgagctcaaagcaagacttctgaaagcaaaggcctaaatgtctgtttggacaatgaggcactccggcattcaagggatattgaagagaaataaaaggattagggacggatggtatactaaatttcaagaggtttatgttttggattggggttactctccaggcactacatttgaacaattaaatctgaatttctattgctgaaattgctgcaagttatttactagtttgcaattgtacacttaacttattgtgttatcaatttgcctaaagaaacccctcattaattgctgctt

SEQ ID NO: 1691 - DNA, 2054 bp, Physcomitrella patens
gttaatgtgcccttccggctgtctttcgggctgtctttcagggctgtgacgtgtaggtgaccagccgtgaagtcgtgggagaggtcctcttgctctgcttgttataagcagccatcgcgtgtgacgcatgacttgttgtcttgtctctccatcgggtagtgagtgtgagaggtccgctgccaggagagagctggtgtcgtcgtctcctgcggaagctcccctcggcacgacgctcttgttcactgcctcaccagctcttgctgcgtttcgcaatggcgttcgcgaagatccatgtcgccaatcccatcgtggagatggatggagatgaaatgaccaggatcatctggaaaatgatcaaggacaagctcatattcccatttctcgacttggacctcaaatactttgatctcggaattgaacatcgagatgctactgacgacagagtgaccattgagagcgctgaagccacgaagaagtacaacgtcgccgtgaagtgtgcgactattacacccgatgaggctcgtgtgaaggaatacaacttaaagtccatgtggagaagccccaacggaaccatcagaaatatcctcaatggtactgtattccgggagcccattctttgcaagaacattcccaaacttgtcccaggatggacgagtcccatctgcattgggagacacgcctttggtgaccagtacaaggctactgatgccgtttttaaaggcccaggaaaactgaagatggtgttcgtcccagagaatgggggagagacccaagatcttacagtttatgacttcgagggtgctggaggcgttgctctgacgatgtacaacactgatgagtccattcgatccttcgctgaatcatctatggcaatggcttatgaaaagaagtggccgttgtatttgagtacaaagaacacaatcctgaagaaatacgatggaagattcaaagacattttccaggaagtttatgagcaggaagggtggaaggctaagtttgacgccgctggaatctggtatgaacatcgtttgattgatgatatggtagcatatgctttgaagagtgagggaggttacgtttgggcttgcaagaactacgacggtgatgtccagagtgacatgctcgcgcaaggttttgggtcccttgggctgatgacatcagtacttgtttgccccgatggaaagaccattgaagctgaagcggctcatggaactgttactcgtcactaccgcgtgcaccagaagggtggagaaacaagcaccaatagtatcgcctctatttttgcgtggacccgaggtctcagtcacagaggaaagttggacggtaacgaaaagttggttgacttcgctacgaagctcgaacaagcatgcgttggcactgtcgaaaatggcaaaatgaccaaggatctagctcttttgattcacggatccaagctctcaagagacacatacttgaacacagaagagttcattgatgcagttgctgaggagttgaagtcgaagctctgaatattgaatttctctgtgaattgtgtgtgcagagcatccgacacgcgttgtgaatgatttgatagtaaataccttagaacccagtgtagggttacacaaacccttttgtagggctgagaacgtcatcgttctgttcaccgctctgagttctttgtcgctggcaggagtagttgtattgctcctactctgcagcggtgcaactgctactttctttcgagtacatttgagtgatcctttgataaactcgcaataccgatcatcccaagcaaatgttggtgagctgtgacgatgtccattatctcctgttcttgcagagtcggagtcaccaggaatcgacttctggtcatcttttctttcgttcaccatagaactggttttgaatccctctccactgaatcttcaacacagttatgccaaatactgagcgttctgacagtcctattttataactggatttgtagaaatggaactgaatatagttttcatttttgtcattaattgacaaccatttgtcacgtttgataaaattcatcatcactttgggtc

SEQ ID NO: 1692 - DNA, 1898 bp, Pinus taeda
  misc_feature (6)..(6): n is a, c, g, or t
gcttcncttagctttttctgagtttggccatttcgatttttccattggatcgtgattttggatcagtaagtccccgaggtggcctgggatcggttcctggacttctttgtcttctatctctctctgctatcacaatggcgtcagagaagatcaaggtggagaatcccatcgtcgagatggacggggatgaaatgaccagggtcatatggacaatgattaaggacaagcttatttttccatttgtagagctggatattaagtattttgatttggggcttccccatcgggatgctacagatgacaaggttacaattgagagtgcagaagccacattaaaatacaatgtggccatcaagtgtgcaactatcacaccagatgaagctagagtcaaggaattcgacttgaaggctatgtggaagagtcccaatgggactatccgtaacattttgaatggtaccgtgttcagagagccaatcttatgtaagaacgtccctaagcttgttccaggatggacaaaggccatatgtattggaagacatgcttttggtgaccaatacaaagcaacagacactgttatcaagggccctggcaagctgaaattagttttcgttccagagaaagatggtgaaacatctgagttagaggtgtacaacttcaaaggtgatggaggagtagcattagccatgtacaatactgatgagtcgatacgttcatttgctgaggcttcaatgaccgtggcctatgagaagaagtggccactctaccttagtacgaaaaatacaattttgaaaaaatacgatggaaggttcaaagacattttccaagaggtctatgaatctaactggaaaagtaaatatgaaaaagcaggaatctggtatgaacataggcttatcgatgacatggtagcctatgcattaaagagtgaagggggctatgtatgggcgtgcaaaaattacgatggtgatgtacagagtgatttcttggcacagggatttggatcccttggcttgatgacgtctgtactggtttgtcctgatggaaaaactatcgaggccgaagcagctcatggcactgtgactcggcattaccgcgtacatcaaaagggaggtgaaactagcacgaacagcattgcttctatttttgcatggacacgtgggcttgcacacagggcaaaactggacggaaatgcaaggctacttgaatttgcagagaagctggaagttgcttgtgtaggaactgttgaggccggaaaaatgacaaaagacttggcgctaattattcacggttccaacctttccagggagcactacctaaacactgaagaatttattgacgcagttgcagaggatctgaaaataagactttctgcgaaaccaaagagttcttaagggattgtgaaatgtgtggcgattttgatcctgcaagagttgtttgaagtcgtaggtcagtcagctactaggggaaatgcatgtggcccatggaatatctgttgtgacacttgaaaggaaaaacatggctgtgtttccaatttaaaactttacagttgcaatagtcattgctatatttcgagggactatttcctcttaaatcttaatactcctgcacagaagtctctaatcagttatcatgggctatgtatgtgcggctacacaagcgcacaagaataaatattgttttaactagaaactccaaagtagatagcagacagcaaaattgtatgcataatgtatgcataatttaaccctggataggtacgcttgattgaatggattcaaagtgtctgcatgtgttgttcttaagttttcttattcaaggatctttgggataaaagaacgggccaaaattaagctgaaaattgttgcatttatagaaatatggacacgtcgtattggccctaa

SEQ ID NO: 1693 - DNA, 1718 bp, Pinus taeda
gagtttggccatagcgattttttccattggatcgtgattttggatcagtaagtccccgaggtggcctgggatcggttcctggacttctttgtcttcaatttctttctgctatcacaatggcgtcggagaagatcaaggtggagaatcccatcgtcgagatggacggggatgaaatgaccagggtcatatggacaatgattaaggacaagcttatttttccatttgtagagctggatattaagtattttgatttggggcttccccatcgcgatgctacagatgacaaggttacaattgagagtgcagaagccacattaaaatacaatgtggccatcaagtgtgcaactatcacaccagatgaagctcgagtcaaggaattcgacttgaaggctatgtggaagagtcccaatgggactatccgtaacattttgaatggtaccgtgttcagagagccaatcttatgtaagaacgtccctaagcttgttccaggatggacaaaggccatatgtattggaagacatgcttttggtgaccaatacaaagcaacagacactgttatcaagggccctggcaagctgaaattagttttcgttccagagaaagatggtgaaacatctgagttagaggtgtacaacttcaaaggtgatggaggagtagcattagccatgtacaatactgatgagtcgatacgttcatttgctgaggcttcaatgaccgtggcctatgagaagaagtggccactctaccttagtacgaaaaatacaattttgaaaaaatacgatggaaggttcaaagatattttccaagaggtctatgaatccaactggaaaagtaaatatgaaaaagcaggaatctggtatgaacataggcttatcgatgacatggtagcctatgcattaaagagtgaagggggctatgtatgggcgtgcaaaaattacgatggtgatgtacagagtgatttcttggcacagggatttggatcccttggcttgatgacgtctgtactggtttgtcctgatggaaaaactatcgaggccgaagcagctcatggcactgttactcggcattaccgcgtacatcaaaagggaggtgaaactagcacgaacagcattgcttctatttttgcatggacacgtgggcttgcacacagggcaaaactggacggaaatgcaaggctacttgaatttgcagagaagctggaagttgcttgtgtaggtactgttgaggccggaaaaatgacaaaagacttggcgctaattattcacggttccaacctttccagggagcactacctaaacactgaagagtttattgacgcagtggcagccgatctgaaaataagactttctgcaaaaccaaagagttcttaagggattgtgaaatgtgtggcgattttgatcctgcaagagttgtttgaagtcgtaggtcagtcagctactaggggaaatgcatgtggcccatggaatatctgttgtgacatttgaaaggaaaaacattggctgtgtttccaatttaaaactttacggttgcaatagtcattgctatgtttcgagggattatttcctcttaaatcttaatactcctgcacagaagtctctaatcagttatcatgggctatgtatgtgcggctacacaagcgcacaagaataaatattgttttaactagaaactccaaagtagatagcagacagcaaaattgtatgcataatgtatgcata

SEQ ID NO: 1694 - DNA, 1798 bp, Populus trichocarpa
ccttttgtcttcgctctgatctctgtctcattttccttctgtgctcaattttcgggaggagaaagaaagatagaaagacaacataaaagtttcaatctttaaaactctctgagcttcctcaaaaaacaagacaacataacaatggctttcgaaaagatcaaggttgctaaccccatcgttgaaatggatggagatgaaatgaccagagttttctggcaatcaataaaggaaaagcttattttcccatttttggagttggatatcaagtactttgaccttggccttcctcatcgcgatgccactgatgataaagtcactattgaaagcgcagaagctactcttaagtacaatgtagcaatcaagtgtgcaactattactccagatgaagatcgtgtcaaggagtttaaattgaagcagatgtggaagagtccaaacggaacaattaggaacattttgaacggtactgtcttcagagaaccaattatttgcaaaaacattccccgccttgtcccaggctggacgaaggcaatttgcatcggaagacatgcttttggtgatcaatatcgagcaactgatgcagtcatcaaaggagctggcaaactcaagctagtgtttgtgccagaaggacaggatgagaagacagagttggaggtgtacaactttacaggtgctggtggggtggcattggccatgtataacaccgatgagtccatccgttcttttgctgaagcttctatgaacactgcttaccaaaagaagtggccactttatctcagcacaaaaaatactatccttaagaagtacgatgggagattcaaggacatctttcaagaagtctatgaggctaactggaaatcaaagtacgaggctgcaggaatatggtatgaacaccgactcattgatgatatggttgcatatgctctcaagagtgaaggaggttatgtatgggcatgcaaaaactatgatggggatgtgcagagtgatttcttggcccaaggttttggatctcttggcttgatgacctctgtattggtgtgccctgatggaaagaccatagaggccgaggcagcccatggtacagttactcggcattacagggttcaccagaaaggtggtgaaaccagcacaaacagtattgcctctatttttgcttggtcaagaggacttgcccacagggctaagttggatgacaatgctaaactcttggatttcactgagaaactagaggcagcttgcgttggagctgtggagtctggcaagatgaccaaggatcttgcattgcttatccatggatctaaggttagtagggaccagtacctcaacactgaagagttcattgatgctgtggccgaggagctgaaagccagactttctgtcgaggcataattgacttggcaggcaaagtgagcagtgcagtaaagcttgattcgagcttcttattggaaggaaataaaggagaggagaaagaaggaagaaaggggatgattagagaattcatgaatttaatcaactcagctttatttttcctctcttcggtctcttgtttgatttagcttcatatcatttcaatttgacttttttttgccagcaacttactataacgtgtttttgatcttattctctgcttacttgcgtttagggctgcttttttctcttttctttttgatctctcggaaggaaaacaagaaaaggacagtcatggccaatatgctgtagatgaaactacagaattaaagttaaataagaatgttatataaccctactttatatttttattattaaataaatgattttgatg

SEQ ID NO: 1695 - DNA, 1721 bp, Populus trichocarpa
gtagttgttgagttttctttttcttctttcatatgatcgcagtgatcacgcagaaacagcaagtgaaaatggcatttgataaaattaaggtcaccaatcccattgtcgaaatggacggagatgaaatgactagagttatttggaaatcaattaaggacaagcttattttcccatttttggatttggatatcaagtattttgacctcggcctgcccaatcgtgatgctacagatgatagagttaccatagaaagtgctgaggctactctcaaatataatgtagcaatcaagtgtgcaacaataactccagatgaaggccgtgttaaggagtttaacttgaaaaatatgtggaagagtccaaatgggacgattcgcaacattttaaatggtacagtttttagagaacctattatctgcaaaaacattccaaggcttgtttcaggttggaccatgccaatctgcataggaaggcatgcatttggtgaccagtaccgagcgactgatacagtcatccaaggccctggcaaactgaagctggtatttgtacctgatggacaaagtgaaaagacagaatttgaggttttcaaattcaaaggagctggaggtgtggctctgtccatgtataacactgatgagtccatccatgctttcgctgaagcttcaatgaacactgcttacctgaagaagtggccgctttatcttagcacaaaaaataccattcttaaaaaatatgatggaagattcaaggacatattccaggaagtttatgaaatgcaatggaaatccaagtttgaggctgcaggaatttggtatgaacatcgtctcattgatgatatggttgcttatgctctcaaaagtgaaggaggttatgtatgggcatgcaagaattatgatggagatgtgcagagtgatttcttggcccaaggatttggatctcttgggttgatgacttcagtattggtgtgcccggatggaaagacaatcgaagctgaagcagcccatggcacggttacccgccattatcgggttcaccagaaaggaggtgaaaccagcaccaacagcatagcatcgatttttgcctggtcgagaggtcttgcacacagggcaaagttggacggcaatgttagactatcggattttactgcaaaactagaagcatcctgcattggagctgttgaatcagggaagatgaccaaggatcttgcacttcttattcatgggcccagggttagtaggggtcggtatctgaatacagaggagttcattgatgctgtagctgaggagctgaaggcaagactgttggtcagagcaaagttgtaaaattctgggttctaaataatttggcagaagctgggttcagctagcatagcatacggacatggtatatttttcaatggttttttcctatcttaattccccatcgcccttgtataagggaatagggtaacgttaagaagtctatccttctggggaagttgaagatggaggtgggcagcaagttgttcttgcagatatggattagaagggactgttgaagactggacagcccaaggagagaaataaaatgggattattataattattataataaacttaagacatgtttgaaataagctagcatgtaatatctgaagagaactgatgatttactggtattgttcgtctcgtgaactgaagtttcttaaattttgaaaaccatggacggcggcgtcaatccacatg

SEQ ID NO: 1696 - DNA, 1685 bp, Populus trichocarpa
gctccacccaacgatcattttgcctcgtttttcttacgtctctaaatttccaacgagtagttgttttatgattgcagtgatcacgcagagacagcaagtgaaaatggcattcgataaaattaaggtcaccaatcccatcgttgaaatggacggagatgaaatgactagagttatttggaaatcaatcaaggacaagcttattttcccatttttggatttggatatcaagtattttgaccttggcctgcctaatcgggatgctacagatgatagagttaccgttgaaagtgctgaggcgactctcaaatataatgtggctattaagtgtgcaacaataactccagatgaaggccgtgttaaggagtttaacttgaaaaatatgtggaagagtccaaatgggacaattcgcaacattttaaatggtacggtttttagagaaccaattatctgcaaaaacattccaaggcttgtttcaggttggaccaagccaatctgcataggaaggcatgcctttggtgaccagtacagagcaactgatacagttatccaaggacctggcaaactgaagctagtatttgtacctgatggacacaatgaaaagacagagtttgaggttttcaagttcaaaggagctggaggtgtagctctgtccatgtataacactgatgagtccatccaggcttttgctgaagcttcaatgaatactgcttacttgaaaaagtggccactttatcttagcacaaaaaataccattcttaaaaaatatgatggaagattcaaggacatattccaggaagtttatgaaactcaatggaaatccaagtttgaggctgcaggaatttggtatgaacatcgtctcatcgatgatatggttgcttatgctctcaaaagtgaagggggttatgtatgggcatgtaaaaattatgatggagatgtgcagagtgatttcttagcccaaggatttggatctcttgggttgatgacttcagtattggtgtgcccagatggaaagacaattgaagcagaagcagcccatggcacggttactcgccattaccgtgttcatcagaaaggaggtgaaaccagcaccaacagcatagcatcgatttttgcttggtcaagtggtcttgcacacagggcaaagttggatggcaatgtcaaactaatggattttactgcaaaactagaagcatcctgcattggagctgtcgagtcagggaagatgaccaaggatcttgcacttcttattcatggtcccagagttagtaggtctcaatttctgaatacagaggagttcattgatgctgtagctgaggagcttagggcaagattgtcagtcaaagcaaagctgtaaaattatggcttctaacttggcaataatatttacccagaagttgggttcaactcgcggcctggacagggactgccaaggactgggcagcctggggggagattgaatggcgttcttatttaactcgaaatgtgtttgaagtgaataagcatgatatctcatgagaattgatgattgattgctctcttggacactgctactgttatttctatgaattcagttcttaaatttcatttcctttgtggccaagaaaaagcgaagaaagacaggcaactcttcttgccttggattgtgcgataatttttccaagcaattacttccgataaattatata

SEQ ID NO: 1697 - DNA, 1639 bp, Populus trichocarpa
gcattatttctccactgtctcttttccttctctactcaattcacgggaggagaaagaaagaaaaacaatcctaaagtttcaatctttaaaactctttcagctcaaacgaaaacaagacaacaaaacaatggctttcgaaaagatcaaggttgccaaccccatcgttgaaatggacggagatgaaatgaccagaattttctggcaatcaataaaggataagcttattttcccctttgtggagttggatatcaagtactttgaccttggtctccctcaccgtgatgccactgatgataaagtcactgttgaaagtgccgaagctgctcttaagtacaacgtagcaatcaagtgtgcaactattactccagatgaagctcgtgtcaaggagtttaatttgaagcagatgtggaagagtccaaatggaacaatcaggaacattttgaatggcactgtcttcagagaaccaattatttgcaaaaacatcccccgccttgtcccaggttggacaaagccaatttgcattggaagacatgcttttggtgatcaatatcgagcaactgatgcagttatcaaaggagctggcaagctcaagctagtgtttgtgccagaaggacaggatgagaagactgagttggaggtttacaactttacaggtgctggtggggtggcattggccatgtataacactgatgagtccatccgtgcttttgctgaggcttccatgaacactgcttaccagaagaagtggccactttatctcagcacaaaaaataccattcttaagaagtatgatggaagattcaaggacatctttcaagaagtctacgaggccaactggaaatcaaagtatgaggccgcaggaatatggtatgaacaccgactcattgatgatatggttgcttatgctcttaagagtgaaggaggttatgtatgggcatgcaaaaactatgatggagatgtgcagagtgatttcttggcccaaggttttggatctcttggcttgatgacctctgtattggtgtgcccagatggaaagactatagaggctgaagcagcccatggcacagttactcggcattacagggttcaccagaaaggtggtgaaaccagcacaaacagtattgcctctatttttgcttggtcaagaggacttgcccacagggctaagttggatgacaatgccagactcttggatttcactgagaaactagaggcagcctgtatcggagctgtggagtctggcaagatgaccaaggatctcgctctgcttatccatggatctaaggttagtagggaccattacctcaataccgaggagttcattgatgctgtggcggaggagctgaaagccagactttctatcaaggcataagtgacttcgcatgcaaagtgagcagtgaaggtaataaaggagagggaaagatggaagagtagggaactcatgaatttaaacaactcagctttattttcttctttccagtctcttgtttgattcaattcaatatcatttcaactgtaatttttgtcgccgactagtttactgcaaggcggttcttaatctcaaatctctgcttactcgatggctatgtcgaagactgcttttatttttatatatatacacatatattctgttttgagt

SEQ ID NO: 1698 - DNA, 1599 bp, Solanum tuberosum
ggcactcggcagtttcttctaccaacttttcttcattcggctgagatttctctgcttaatttttctctcaatctgcaaaatggcgtttcagaaaatcactgtgcaaaaccccatcgttgagatggacggagatgaaatgacacgagttatttggaaatctatcaaggataagctcatccttccctttctggaattggacataaaatactttgaccttggccttccccaccgtgatgccacagatgataaggttacagttgaaagtgcggaagccactcagaagtacaacgtagctatcaagtgtgcaaccatcaccccagatgaggcccgtgtaaaggagtttaacttgaaatccatgtggaggagcccaaatgggacaatcagaaacatcttaaatggaactgtctttagagaaccaattatgtgcaaaaatatccccagacttgtcccaggttggactaaaccaatttgcattggtagacatgcttttggagatcaataccgagctactgatacagttattaaaggagctggaaaactcaaattggtgtttgtgccagaaggatcagacgagaagactgagtttgaagtttacaactttactggtgctggtggagtagctttatccatgtacaacacagacgagtctgttcgttcatttgctgaggcttcaatgaacatggcattccaaaagaaatggccactctatcttagtacaaagaataccattcttaagaaatatgatgggaggttcaaggatatcttccaagaagtttatgaagcaaattggaagtccaagtacgaggaagccggaatctggtacgaacaccgtcttatcgacgatatggttgcttatgctttaaagagtgaaggtggttacgtatgggcttgcaagaactacgatggggatgttcagagtgatttcttagcacaaggttttggatcccttgggttgatgacttctgtcctggtgtgtcctgatggcaagaccattgaggctgaagcagcccatggaactgttacccgccactacagggttcaccagaaaggaggtgaaaccagcacaaacagcattgcctctatctttgcctggactcgtggacttgcacacagggcaacattggacaacaacgaaaggctcttggattttactgagaaactagaggcagcatgcattggtgcagtggaatctggaaagatgacgaaagatcttgcactcatcatccatggatccaagctttcacgagagcattatctgaacacggaagagttcattgacgctgttgccgatgagctcaaagcaagacttctgaaagcaaaggcctaaatgtgtgaggacaagtctttcttcctcaggcagtttgaggcatattgaattgaagagaaataaaaggagttaaggccttgtttggtatactaaatttcaagaggtttttatcttttaggttgaggattattctgcagacattatatttgaaccatttaaatctgaattcctattgctgatgttgctgcaagttatttgccaatttgtagttgtacacatagcttattgttgcctttttatatcaatttgcttaaagaaaccctttcttcatt

SEQ ID NO: 1699 - DNA, 1759 bp, Prunus persica
gattcctatctaccttcctatctacctatccaacctatcgtcccacggagaaaacaatggctttccagaagatcaaggtggccaaccccatcgtggagatggacggagatgaaatgacgcgagttttctggaaatccataaaggataagcttattttaccctttttggaattggacatcaagtactttgaccttggtcttcctcatcgtgatgccactgatgataaagttactgttgaaagtgcagaggctactcttaagtacaatgtagcaatcaaatgtgcaactatcactccagatgaaggtcgtgttaaggagtttaacttgaagagtatgtggaggagtcccaatggcactattaggaatattttgaatggtactgttttcagagaaccaattctttgcaaaaacatccctcgccttatcccaggctggacaaagccaatatgcattggaagacatgctttcggtgatcagtatcgagcaactgatgctgtcattaaaggacctgggaaactgaaattggtgtttgtgccagacggaaaggatgagaaaacagaactagaggtgtacaacttcacaggtgaggggggagtagcattggccatgtacaacactgatgagtccatccgtgcttttgcagaggcttccatgaccactgcttatgagaaaaagtggcctctttatcttagcacaaagaacactattcttaagaagtatgatggaagattcaaggacatatttcaagaagtttatgaagccaagtggaagtcacagtatgaggctgctggcatatggtacgagcaccgtctcattgatgatatggtggcttatgcacttaaaagtgatggtgggtatgtttgggcatgcaagaattatgatggagatgtgcagagtgatttcttagctcaagggtttggctctcttggattgatgacatcagtactggtgtgcccagatggaaagactatagaagcagaagctgcccacggtacagttactcggcattacagggttcaccagaaaggaggtgaaaccagtacaaacagcatagcttctatctttgcttggacaagagggcttgcacacagggcaaagttggatgacaatgcaaagcttttggatttcactcagaaactggaagaagcttgcattggaactgtggaatctgggaaaatgaccaaggatcttgcactcattattcatggacctaagcttgctaggaaccactacttgaatacggaagagttcattgaagctgtggcagaggaactcagagcaaggctttcttgaaagaatagttgtacgtgaggggtttgcagacttgactctatgcattgggatagacaactgtggacttgtccttttgtactcccgaaagaaataatggaaggcggaatctttcccctctggtggttagagatgttgactcatctgtttttagtgtattagtttcttgtgcacaatttaattgctcgactcttactgatttgaatgttctttcttcatcagtttgcttccgcaagcaagtttgacctttttcatggctaagccaattttagtgatttccagcaagaaatcaagttttagaagctctgtttgcaaaaatgacatttgaaaatcacctctgtggtttgtagcccaagtgtgtaatggttctgatcttttcttggctatttcaagaacagacaacttatggtcaaaaaaacattggaaatttagaaccatgcaatacagttctgatattttcattggtcaaa

SEQ ID NO: 1700 - DNA, 1728 bp, Raphanus sativus
  misc_feature (48)..(48): n is a, c, g, or t
  misc_feature (597)..(597): n is a, c, g, or t
ggacctactcctcgcactcaccaaaccagcgccgatccgatccgcatntctcgcccgaaaaccttgtctcgttttgtagatcgccgacgaggttgacatacctttctgatctactgaatcagtctttctaacggaaaaaaaacaatggcgtttgagaagatcaaggttgcaaatcccatcgtcgagatggatggtgatgaaatgacccgagttatctggaagtccatcaaggacaagcttatcactccttttgtggagttggatatcaagtacttcgaccttggtcttcctcaccgtgatgctaccgatgacaaagttactattgaaagtgctgaagccactaagaagtataatgtggcgatcaagtgtgccaccatcactccagatgaaggccgtgtcacggaatttggcttgaagcagatgtggagaagtcccaatggtaccatcaggaatattctgaatggaactgtgtttagagaaccaattctctgcaaaaatgttcctaagcttgtcccaggctggacaaagccaatctgcattggaaggcatgcttttggtgatcagtaccgtgccactgatgctgttatcaagggaccnggaagactgactatgactttcgagggaaaagatgggaaaactgaaactgaagtgttcacatttaccggtgaaggcggtgttgctatggccatgtacaacactgatgagtccatccgtgcttttgctgacgcatcgatgaacactgcttatgagaaaaagtggccactttatcttagcacaaagaacaccattcttaagaaatacgatggcagattcaaagacatcttccaggaagtgtatgaagccagctggaagtcaaagtatgaggctgctggaatatggtatgaacatcgtctcattgatgatatggtggcttacgctcttaagagcgagggaggctatgtgtgggcatgcaagaactacgatggtgatgtccaaagtgatttcctggcacaagggtttgggtcacttggattgatgacatctgttctggtctgcccggatggaaagacgattgaagcggaagcagcacatggaacggtaacccgtcactacagggttcaccagaaaggtggggagaccagcacaaacagcatagcatctatttttgcttggactcgtgggcttgcacacagggctaagttggatgacaactcaaaactattggaatttaccgagaagctagaagctgcttgtgtgggtacagtggagtctggaaaaatgacaaaagatcttgcactcatcattcacggctcaaagctctcaagggacacttacttgaacacagaggagttcatcgatgcggttgcagatgagctcaagcggcggttattttatggggtgtcgaaaatttaactacaaaaaacatggtgtcaggctgggtttgaaccctgattaatggaggtgttaagagatggattgtaccttagatgacaaaaacttcttgttacttttacccagcataatttattcaaatttaaggggtcatgtgacaccccattacacaaacttaggaagtgtggtcagatcctcggtcataagtgtcttatctagtggggttgtgaaagtagtttgggttggaagaaagaaataaaagagaacgttttcttaatgggtacattgaaaaggattattttccaaacaatgagacatgcttcctttttgtttatttgtcattgattttcgtgacca

SEQ ID NO: 1701 - DNA, 1573 bp, Raphanus sativus
ggacctactcctcgcactcaccaaaccagcgcgatccgatccgcatatctcgcccgaaaaccttgtctcgttgtagatcgccgacgaggttgacatacctttctgatctactgaatcagtctttctaacgaaaaaaaacaatggcgtttgagaagatcaaggttgcaaatcccatcgtcgagatggatggtgatgaaatgacccgagttatctggaagtccatcaaggacaagcttattactccttttgtggagttggatatcaagtacttcgaccttggtcttcctcaccgtgatgctaccgatgacaaagttactattgaaagtgctgaagccactaagaagtataatgtggcgatcaagtgtgccaccatcactccagatgaaggccgtgttacggaatttggcttgaagcagatgtggagaagtcccaatggtaccatcaggaatattctgaatggaactgtatttagagaaccaattctctgcaaaaatgttcctaagcttgtcccaggctggacaaagccaatctgcattggaaggcatgcttttggtgatcagtaccgtgccactgatgctgttatcaagggacctggaagactgactatgactttcgagggaaaagatgggaaaactgaaactgaagtgttcacatttaccggtgaaggcggtgttgctatggccatgtacaacactgatgagtccatccgtgcttttgcggacgcatcgatgaacactgcttatgagaaaaagtggccactttatcttagcacaaagaacaccattcttaagaaatacgatggcagattcaaagacatcttccaggaagtgtatgaagccagctggaagtcaaagtatgaagctgctggaatatggtatgagcaccgtctcattgatgatatggtggcttacgctcttaagagcgagggaggctatgtgtgggcatgcaaaaactatgatggtgatgtccagagcgatttcctggcacaaggattcgggtcacttggattgatgacatctgttctggtctgcccggatgggaagacaattgaagctgaagcagcccatggtaccgttacccgtcactacagggttcaccagaaaggtggagagaccagcacaaacagcatagcctccatctttgcttggactcgtggacttgcacacagagctaagctggatgacaactcaaaactcttggagtttactgagaagctcgaagctgcttgtgttggtacagtggagtctggaaaaatgaccaaagatcttgcgctcatcattcacggctcaaagctctcgagggatacttacctcaacacggaggagttcatcgatgcagttgcggatgagctcaaaacaagactcggcgcttaagaaaacattcgacgacttagtcataagtgtctaatctggtgggtttgtgagagttgaaggaataaaagagagaacgtttgcgttttgagaacgatttgtttcatctgctataatattttcaaaacattgttacatgtttccctttcttatgcagatttcaaataatttttcattgattatccacacttttttattgatca

SEQ ID NO: 1702 - DNA, 2349 bp, Oryza sativa
ggcgcggccgaacgcccgcgccgtgtctgcttatgatgcttcgttctctccgcgctccgtgtccgaccttcttcagacttcacacctcgcgcgccgccgcagctccgatcggaagaagctcgattcgtctccgactccgacgaccagaagctaccggcgacgcgagcggagaagcgcggaggggagggggcgcgcgccgccatggcgttcgagaagatcgtcgtggccaaccccgtcgtcgagatggacggtgatgagatgactcgagttatttggaaatggatcaaagataagcttatattccctttcttggacttggacataaaatactatgacttaggtctacctaatcgtgacgctactggggacaaagttacaatagagagtgcagaagcgaccctaaagtataatgtagccatcaaatgtgcaactataactccagatgaaggacgcgtgaaagagtttaatttaagtgcaatgtggaagagtccaaatgggacaataaggaacattttgaatggaactgttttccgagaaccaatcatctgcaagaatattcctcggcttgtacctgggtggataaagcccatatgcattggacgacatgcatttggtgatcaataccgagcaacagatacagttattaaaggtcctgggaagttgaagttagtatttgatggcagagaggaacaaatagagttggatgtgttcaactttactggtgctggtggagtagccttgtctatgtataatactgacgagtctatttgggcattcgctgaagcttccatgaacatggcttaccagaaaagatggccactttatcttagcaccaaaaacacgatcctcaaaaaatacgatggaaggtttaaagatatatttcaggagaactatgaaacaaaatggagagccaagtttgatgatgcaggaatatggtacgaacatcggctgattgatgatatggtggcctatgcccttaagagtgaaggtggctatgtttgggcttgcaagaactatgatggagatgtgcagagcgatctaattgctcaaggttttggatcgctaggtctaatgacatcagttctggtgtgccctgatggtagaaccattgaagctgaagctgctcatggtacagtcacacgccattacagagttcaccaaaaaggaggcgaaactagtacaaatagcattgcttcaatatttgcttggacaaccggactaggacatagggcaaagctcgatgacaataaaagactgttagattttgtacaaaaacttgaagctgcttgtgtgggaacagtggaatctggaaagatgacaaaggatctagctcttcttgtacatgggccaaatgttagccgagataagtatcttaacactgttgagttcatcgatgctgttgctgaggatttaagaacaagattgtcagtaacatccaagttatgaaggaatgaatagggcaacggcaggggacatgttaggatcccatgatacaaagtttatacatttttactttgaataagagcgattgaagcattggtatgcgcagctatcaaccacggtgctctgataaaatctggtaaagattgtatgcatactccatacaacaatggaggtggaggaggatattttgctcgaaataagaagtttgaacttttattcgtcagacttctacttataactactttgatgattaaatcatggccgtgtagcttagttcttctatgccaaaagagcaagtagaactatcctaaaggtacccaccacaagtggtgtttgtgctttgtaccatacaaacaagactgtttatttactacagtatatagcttggaataaaaaagcaggtgcagatctgttggtaatctggagtaggacatttgaatgggtgacatgctgtgttggttacccattgcttcagtttcctcccatgacagggcatcctgagcctgacgcagcctcagcagcagcagcagcagcaggcgtgctcaagaagctcgcgaggaaattgccgcgctcgtagaagtactccgtcttctccaccttcatctcctcgtcgacctaatgccgcatcgccaacacagaactgtcagtgctacgtatataagtggtggttatcgatgggaagacttgaaaagggttcaaaactccgaatttacaatctttctggctggtaatgggtaaaaaaaattcaaagtgctggatatcaacttttaatgataactccccttaaaaagaggtactaaaatccagttactgatggcgggcaattgtagacaaacgggtagtatttggaaacctcttgtcactgttggaaaagaaagatacataacaataactatagcttttact

SEQ ID NO: 1703 - DNA, 1825 bp, Oryza sativa
atacctcccacccgtctgttctttaaatgcgctcgcccaactgctcgcatctttctctctgcccgtgccaatcttcctttcccacatcctcctccgccgccggctgcttcccaccggctcccgatctccgaggcaagcagcgccgcacccggccgctgccgccgccgccatggcgttcgagaagatcaaggtcgccaaccccatcgtcgagatggacggtgatgagatgaccaggatattctggcagtctatcaaggacaagcttatctttccatttttggatctggacattaagtactatgacttgggagttctccaccgtgatgcaactgatgacaaggtcaccgtggaggctgcagaggctactctcaagtacaatgtggctattaagtgtgcgacgattactccagatgaggctcgggttaaggagttcaacctaaagcaaatgtggaagagccccaatggcacaattaggaatattatcaatggcactgtattcagagagccaattatatgcaaaaatgtcccaaggcttgttccaggatggactaagcccatttgcattggaaggcatgcttttggtgatcagtaccgagcaactgatgcagttctgaaggggcctggcaagctcaagctggtttttgagggaaaggatgagcagattgatctggaggtgttcaacttcactggtgctggaggagttgctttgtctatgtacaacactgatgagtcaatccgagcttttgctgaagcttctatgacaactgcttatgagaagaaatggccgctttatcttagcaccaaaaacacaatcctgaagaaatatgatggaaggttcaaggatattttccaggaggtctatgaagctgggtggaaatccaagtttgaggctgccggaatatggtatgagcatcgtctcatcgatgacatggttgcttatgcacttaagagtgaagggggctatgtgtgggcttgcaagaattacgatggagatgtgcagagtgatttcttagctcaaggctttggttcattgggtttgatgacatcagtattggtgtgccctgatggaaaaacaattgaagctgaagctgcccatggcacggttacccgtcatttccgtgttcaccagaagggaggtgaaaccagcacaaacagcattgcttcaatctttgcttggaccagaggacttgcacacagggcaaagcttgacgacaatgctagacttcttgactttgcactaaaacttgaagctgcttgcgttggaaccgtggaatctgggaagatgaccaaagaccttgctcttcttattcacgggtcttcaaacgtcacaagaagccattacctgaacactgaagagttcattgatgcggttgctgcggagctccggtcaagactggcagccaactgagctttttacaagatactcttgccaacttcagtgcttcatttcccttcttttaaagtcattttggctgtatcaccattaccattcgagttctcattctggactgaatgaacatttacagcatcggtacaaattgttgtcgatccaagcagtccatagatgctgatatcacgtagacgggacctcccaaataaaggatatatagaacaatctgtcattgctgatagttgttttatccctatcagttagcgtccgactggaaaattatctatgttcctcatttggatggtttgataatttcttgattgataattcgtaccttggaatctgggctgaaggaagcatggtgcacaattcgaagtttaattgtgttgtcgtaaagaggttgaagtaaggttttaactgtgaagcttctgtaaa

SEQ ID NO: 1704 - DNA, 1413 bp, Secale cereale
  misc_feature (576)..(577): n is a, c, g, or t
  misc_feature (579)..(579): n is a, c, g, or t
  misc_feature (670)..(674): n is a, c, g, or t
ccatcgtcgagatggacggtgatgagatgaccagagtattctggcagtctatcaaggacaagcttattttcccattcttggacttggacattaagtactttgacttgggagttctgcaccgcgatgcaactgatgacaaggttacagtggaggctgcagaggctactctcaagtacaatgtggctattaagtgtgcaactattactccagatgaagatcgggttaaggagttcaacctaaaacaaatgtggaggagcccaaatggcacaattaggaacattataaacggcaccgtgttcagagagccaattatatgcaagaatgtcccaaagcttgttccaggatggactaagcccatctgcattggaaggcatgctttcggtgatcagtacagagcaactgatgctgttctcaagggacctggcaaactcagactagttttcgagggaaaagatgagacagttgacctcgaggtttttaacttcactggtgctggaggagtcgccttggctatgtacaacacagatgagtcaattcgaggctttgctgaagcttctatggcaattgcttatgagnngnaatggccgttgtaccttagcacaaaaacacaatccttaagaatatgatggcaggttcaaggacattttccaggagatctatgaagctggcnnnnnatccaaatatgaggctgccggaatatggtatgaacatcgtctcattgatgacatggttgcctatgcacttaaaagcgaaggaggctatgtttgggcttgcaagaactatgacggagatgtgcagagtgatttcttagctcaaggttttggctcgttgggcttgatgacgtcagtattgatgtgccctgatggtaaaaccatagaagctgaagctgcccatggcaccgtcacccgtcatttccgtgttcaccagaaaggtggtgaaaccagcacaaacagcattgcttcaatctttgcttggacaagaggacttgcacacagggcaaagctagacgacaacgctagacttcttgaatttgcacagaaacttgaggacgcatgcgtcggaactgtggagtctgggaagatgaccaaggaccttgcactccttgttcatgggtcttcaaaagtgacaagaagcgattacctgaacactgaagagttcattgatgcagttgctgctgagctcaaatcaagactgtgaaagacctcttccacttcaatgcttgaatagtcattactcatcgattcaagtcattttggtcatgtcgccattatctgtcatgctttcatcctgagcagaacgagcatttactgcaccatcgcatattattgtcaaaaatgcaatcgattctgtagatgctgatgttgtgtaagtcgggctcacaataattgacatataaaaggattattcacttct

SEQ ID NO: 1705 - DNA, 1562 bp, Carthamus tinctorius
  misc_feature (1448)..(1448): n is a, c, g, or t
gcattggcgggcccactccatcactgtcgtcgtctccctctttctcacttgtcatttcacttttctccgatcggctggaaatggctttcgataagatcaaggttaccaaccccatcgttgagatggacggagatgaaatgactcgcgtcttttggcaatcgataaaagataagctcatcttccccttcgttgaactggacataaagtattatgaccttggccttcctaatcgtgatgctactgatgacaaagtcaccatagaaagtgctgaagccactctcaagtacaatgttgcaatcaagtgtgccaccatcactccagatgaggctcgtatgaaggagtttaccttgaaaagcatgtggaagagtccaaatgggacaatccgtaatattttgaatggcactgtttttagagaaccaattctttgcaaaaacattcccaagctagttccaggatggacaaagccgatatgcattggaagacatgcatttggtgatcagtacaaagctactgatgcagtgattaaaggacctgggaagctgaagatggtgtttgttcctgaaggagaaggtgaaacaacggagttggaggtttacaacttcactggtgctggaggggtagctttgtcaatgtacaacactgatgagtccattcgtgcttttgctgaggcctcaatgaacacagcttatgagaaaaagtggccactctatcttagcacaaagaataccattcttaagaaatatgatggaagattcaaggacatatttcaagaagtctatgagagcaactggaagtcaaagtttgaagctgctgggatatggtatgaacaccgtctcattgatgacatggttgcgtatgctcttaagagtgatggaggttacgtatgggcatgcaaaaactatgatggtgatgttcaaagtgatatgttagcacaagggttcggatctcttggattgatgacgtcagtcctggtgtgtcctgatggaaagaccattgaagctgaagcagcccatggcactgtaacgcgtcactacagggtgcaccaaaagggaggggaaaccagcacaaatagcatagcctcaatctttgcatggacccgagggcttgcccacagggcaaagttggataacaactctaagcttttggaattcactgagaagctggaagcagcatgcattggaaccgttgaatctgggaaaatgacaaaggatcttgcactcattattcatggatccaagctgagtagggagcactatttgaacacagaagaattcattgacgctgtagcaaacgagctgaaagcaagacttattggcaaatcatcactgtaaggtgacacttgagggtgatgatacatgaggaagatttatatggtatggttgtgtttaatcgtccgtcatttgtgcactctatttctggtttgattgaattcgggaaagcaacacagnaacatcaccatggctatcagcataacgatggttatggtcatttgaaggatttgtttctatcttttctctgaggacctagtttcatcaatttcagtctgaagggaatttttatgg

SEQ ID NO: 1706 - DNA, 1475 bp, Carthamus tinctorius
cgcgggacatccccccagttttcgcacttgctctcgctctctctctctgacttccggttgccggccggagtttctccatcgtcctacgaatctccgatcatccgtcatttggaaatggctttccagaagatcaaagttgcaaatcccatcgttgagatggacggagatgaaatgactcgcgtcttttgggaatcaattaagaacaagctcatctttcccttcttagatctcgacataaagtattatgatcttggccttcttaatcgtgatgccaccgatgataaagttaccgtagaaagtgctgaagctactcttaagtacaatgttgcaatcaagtgtgccaccattactccagatgaggctcgtatgaaggagtttaccttgaagagcatgtggaagagtccaaatggtaccatcaggaacattttgaacggcacggtttttagggaaccaattctctgcaaaaacattccaagactgataccaggatggacaaagccaatatgcatcggaagacatgcttttggtgatcagtacaaagctactgatgcagtgattaaaggccctgggaaactgaagatggtatttgttcctgaaggacaaggggaaaacatagatttggaggtttataacttcacaggggctggaggggtagctttgtcaatgtacaacactgatgagtccattacttcgtttgctgaggcctcgatgaacacagcctacttgaaaaagtggccactttatctaagcacaaagaataccattctaaagaagtatgatggaaggttcaaggacatattccaagaagtttatgaaagcaactggaaatcgaagtttgaggctgctgggatatggtatgaacaccgtctcatcgatgatatggttgcatatgctcttaagagcgatggaggctatgtatgggcatgcaaaaactatgatggggatgtgcaaagtgatttcttagcacaaggtttcggatcacttgggctaatgacgtcggtcctggtgtgtcctgatgggaaaaccattgaagctgaagcggcccatggcaccgtgacacgtcattacagggtgcaccaaaagggaggtgaaactagcacaaacagcatagcatccattttcgcttggacccgaggacttgcccacagggcaaagttggatgacaacgctaagcttttggatttcaccgaaaagttagaagcagcttgtattggttgtgttgaatccggcaagatgaccaaggatctcgctttaatccttcatggatccaagctgagtagggaacactacttgaacaccgaagaattcattgatgctgtggccgatgatctgaaagcaagactctccgccaattagtcaacataatgagagttggttggatggaaataaggaagaaaggagagatgtgattgagaatatttttattcttaatttgatttatgaattgctacaattagtacttggtagggtcttat

SEQ ID NO: 1707 - DNA, 1589 bp, Solanum phureja
attttttctccattttgttacaatttaagcttctcccgccggcgaaattttctttatcaaacaccattactctttatattaccagaatttccagttcttgatctcaatttttcactaaaaatggcttttcaaaagatcaaagtggctaaccccatagttgaaatggacggagatgaaatgacccgtgtcatttggaaattaattaaggataagctcatcttgccttttctggagttggatataaaatacttcgatcttggccttcctcaccgtgatgccacagatgataaggttacaattgaaagcgctgaggctactttgaagtataatgtagctattaagtgtgcaaccatcactccagatgaggcccgtatggaagagtttaacttgaagcatatgtggaagagcccaaatgggacaattaggaacattctgaatggtacggtgttcagggaaccaatcctctgcaaaaacattccccgacttgttccaggttggtcaaaaccgatatgcattggcagacatgcttttggtgatcaatatcgagctactgatacagtgattcaaggagctggaaaactcaaattagtatttgtaccagaagggacggatgaaaagaccgagttcgaggtttacaacttcactggtgctggtggagtagctctatccatgtacaacacggatgagtctatttgctcttttgctgaagcttctatgaacatggcataccaaaagaaatggccactctatcttagcacaaaaaataccatccttaagaaatacgacggaagattcaaggacatattccaggaagtttacgagtcaaaatggaagtcaaagtttgaggaagctgggatctggtacgaacatcgcctcatcgatgatatggttgcttatgctttaaaaagtgacggtggttatgtatgggcatgtaaaaactatgatggagatgtacagagtgatttcttagctcaaggatttggatcgcttggattgatgacatcgatcctgatatgtccggatggaaagactgtggaagcagaagcagcccatggaactgttacacgccactacagggttcatcagaaaggaggtgaaaccagcacaaatagcattgcctcgatttttgcttggactcgtggacttgcacatagggcaaagttggacaacaatgctgcactcttagatttcaccaagaaactagaagcagcttgcatcggtgcagtggaaaatgggaaaatgaccaaagatctagcacttattatccacggatccaaggtcgctagacgtcaatatgtaaacactgaagagttcattgatgctgtggctgatgagctgaaagctagacttctgaaagcaaagatataagtataggtttccactaagaggagaaatacattttgccagaactttgaggtgtggattcatatagacgatctgaacttgtttgagattaaggtgtcgtagttgttgtattatggctctagtacatcattattcactaatccacccttaaccctggattagtgtgttcttgttcccctcatcgatccatgtggaaaataaaattttaattttcagttgatttt

SEQ ID NO: 1708 - DNA, 1591 bp, Solanum phureja
gcactctgcattttcttctaccaacttttctccattcggctgagatttctctgtttattttttctctcagtctgcaaaaatggcgtttcagaaaatcactgttcaaaaccccatcgttgagatggacggagatgaaatgacacgagttatttggaaatctatcaaggataagctcatccttccctttctggaattggacataaaatactttgaccttggccttccccaccgtgatgccacagatgataaggttacagttgaaagtgcggaagccactcagaagtacaacgtagctatcaagtgtgcaaccatcaccccagatgaggcccgtgtaacggagtttaacttgaaatccatgtggaggagcccaaatgggacaatcagaaacatcctaaatggaactgtctttagagaaccaattatgtgcaaaaatatccccagacttgtcccaggttggactaaaccaatttgcattggtagacatgcttttggagatcaataccgagctactgatacagttattaaaggagctggaaaactcaaattggtgtttgtgccagaaggatcagacgagaagactgaatttgaagtttacaactttactggtgctggtggagtagctttatccatgtacaacacagacgagtctgttcgttcatttgctgaggcttcaatgaacatggcattccaaaagaaatggccactctatcttagtacaaagaataccattcttaagaaatatgatgggaggttcaaggacatcttccaagaagtttatgaagcaaattggaagtccaagtacgaggaagctggaatctggtacgaacaccgtcttatcgacgatatggttgcttatgctttaaagagtgaaggtggttacgtatgggcttgcaagaactacgatggggatgttcagagtgatttcttagcacaaggttttggatcccttggtttgatgacttctgtcctggtgtgtcctgatggcaagaccattgaggctgaagcagcccatggaactgttacccgccactacagggttcaccagaaaggaggtgaaaccagcacaaacagcattgcctcaatctttgcctggactcgtggacttgcacacagggcaacattggacaacaatgaaaggctcttggattttactgagaaactagaggcagcatgcattggtgcagtggaatctggaaagatgacgaaagatcttgcactcatcatccatggatccaagctttcacgagagcattatctgaacacggaagagttcattgacgctgttgccgatgagctcaaagcaagacttctgaaagcaaaggcctaaatgtgtgaggacaagcagtttgaggctattgaattgaggagaaataaaggagttaaggcgttgtttggtatactaaatttcaagaggtttttttttttaaatctttttaggttgaggattattctccagacactatatttgaaccatttaaatctgaattcctattgctgatgttgctgcaagctatttgccaatttgcagttgtacacatagcttattgttgtttttttaatatcaatctgcttaaagaaacccctcttcatt

SEQ ID NO: 1709 - DNA, 1856 bp, Sorghum bicolor
ctcgcagactctcttccttctctcttcccctgcctctgcggctctgcctgccatctctcttcctccttccacaggcgccgccgcaggccccttcccgatctccgaggcaaagctgcgaccccgccaccgccgccatggcgttcgagaagatcaaggtctccaaccccatcgtcgagatggacggtgatgagatgaccagggtattctggcagtctatcaaggacaagcttatttttccatttcttgatctggacatcaagtactatgatttggggatactgcatcgggatgcaactgatgacaaggtcacagtggaggctgcagaggctactctcaagtacaatgtggctattaagtgtgcgaccatcactccagatgaaactcgggttaaggagttcaacctgaagcacatgtggaagagcccaaatggcacaattaggaacattataaacggcactgtgttcagagagccgattatatgcaaaaatgtgccaaggcttgttccaggatggactaagcccatctgcattggaaggcatgccttcggtgatcagtaccgtgctactgatgcagttctgaaggggcctgggaagctgaagctagtttttgagggaaaagaagaacagattgatctggaggtgttcaacttcactggtgctggaggagttgccttgtctatgtacaacactgatgagtcaattcgagcttttgccgaggcttctatgacaactgcttatgagaagaaatggccactctaccttagcaccaaaaacacaatcctgaaaaaatacgatggcaggtttaaggacattttccaggaggtctatgaagctggctggaaatcaaaatttgaggctgctggaatatggtatgagcatcgtcttattgatgacatggttgcgtatgcgcttaagagtgaaggaggctatgtgtgggcttgcaagaattacgatggagatgtgcagagtgatttcttagctcaaggttttggctctttgggtttgatgacatcagtgttggtgtgccctgatggaaaaaccattgaagctgaagctgcccacggcacagttacccgtcatttccgtgttcaccagaaaggaggtgaaaccagtacgaacagcattgcttcaatctttgcatggacaagaggacttgcacacagggcaaagctggatgacaatgctaggctactcgacttcgctctcaaactcgaggctgcttgcgtcggaactgtggagtctgggaagatgactaaagatcttgcacttcttgttcatgggtccgccagcgtcacaagaagccattacctgaacactgaagagttcatcgatgcagttgctactgagctccgatcaagattgggagccaattgagcttacaagaaactttgtgcatggcgacttgaatgcttcatcaccgatctgctccagtcatttctgttacattggtactgccagtcatgcttccgtgatgaattgaatgtgcgtcatcgcaatgcaatttcgatcgaagctgattaaagatgatggtgtcacgtgagcgcccataataaaggatatatagaacaactgtggcagatgattaaaatacttttatgtttgctaagttcagtcattccctgggtattttcttgttttctccttttctgtagttcacaaatcacgcagttcgttcggtttggtttgcccattccgtagttcgccgataaccgtatgcactcggtttttccatcatcatcaagtaaacagatgccttccgttaaaaaaaaaacccaaaaaactatgtatatgctaactctttcgatgttaccgttttggcccacaaatggagatgacgtcacccgtgtttgttgtcct

SEQ ID NO: 1710 - DNA, 1658 bp, Sorghum bicolor
aaaaccctcccactccatgatgatgatcccccgctccttcagtcatctcctcctccccaagacacccaccaaccccgtccagccgccggctgtctcggccgccgccgccgccgccctctcccggtccctgaggcgcgccaggtcggccatggcgttcaacaagatccaggtcgccaaccccgtcgtcgagatggacggcgatgaaatgaccagggtgttctggaaatctatcaaggacaagcttatcttccctttcgtggacctggacatcaaatactttgacctcgggcttccatatcgtgatgaaaccgatgacaaagtcacagtcgaggctgcggaggccacactcaagtacaatgtggctatcaagtgtgccaccattacaccagacgaagcaagggtgaaggagtttggcttgaaggccatgtggaagagcccgaatggcacaatcaggaacattctgaatggcactgtgttcagagaaccaatcatctgcaaaaacatcccaaggcttgttccaggctggacaaagcccatttgcattgggaggcatgcattcggtgatcaataccgggcaactgatgcagttatcaagggacctggcaagctcaaattagtttttgagggaaaagaagagcaagttgaactggaggtgttcaacttcactggtgctggaggagttgccttatccatgtacaacactgacgagtccatccatgcctttgctgaggcttctatggccactgcttatgagaagaaatggccattgtaccttagcaccaagaacacaattctgaagaaatatgatggcaggttcaaggacattttccaggaggtgtacgaagctggttggaaaaccaaatttgaagctgccggcatatggtatgagcatcgtctcattgatgacatggtagcatatgcacttaagagtgaaggagggtatgtctgggcttgcaagaattatgatggagatgtgcagagcgatttcttagctcaaggttttggctcattgggtttgatgacatcggtactggtgtgccctgatggaaagacgatcgaagctgaagctgcccatggtactgttacccgtcattaccgtgttcatcagaaaggaggtgaaaccagtacaaacagtattgcctcaatctttgcttggacaagaggacttgcacacagggcaaagcttgatgacaatgctagactacttgacttcacccagaagcttgaggctgcctgcattggggctgttgagtctgggaagatgaccaaggatcttgcccttcttgttcacggatctgcaaatgtcacgaggagccattacctgaacaccgaggagttcatcgacgctgttgctgatgagctcagatcaaggctggcggccaactcaaacctatgaaatccttgctgaagttctgatgcttccttgcacgacgattcgagtcatttttcttatgtcgccattttctatccttgtgccaccaccctgaaaggctgaactaggcgaatatctgcaggctgcagcagtatgccagatcattaccaatgagagattgtgctagattccgcgattatggaactcatataccttattatctgatacattttacgttttttaaaaaaatatctgatacatttcaataaagtccattcagaatgct

SEQ ID NO: 1711 - DNA, 1796 bp, Glycine max
aggtgaggctgcggaaatcattacttataatagtcttgtacgattattcatagtgcggcaatagcagagcagcgactcacactggtcttcgcttctcattcatcatttctcacctaaccttctcttcctctcagtctcagatcagaaacctcagccagccatggcagcgttccagaagatcaaggtcgtcaaccccatcgtcgagatggacggagatgaaatgactagggttatctggaagtcaatcaaggacaagctcattttgcccttcttggagttggacatcaagtattatgacttaggccttccttaccgtgatgagaccgatgataaagttacaattgaaagtgcagaagcaactctcaagtacaatgtagcaatcaagtgtgcaactatcactccagatgaagctcgtgtgaaggagtttggcctgaagtcaatgtggaagagtccaaatgggactattaggaacattttgaatggaactgtcttcagagaaccaattctttgcaaaaacattccccgccttgttcctggttggacaaaggcaatatgtattggaaggcatgcgtttggtgatcaatatcgggctactgacactgtaattaaaggagctggaaagctgaagctggtgtttgttccagaaggccaaggtgaggaaactgaattcgaggtttttaacttcactggtgaagggggtgtttcattggctatgtacaatactgatgagtctattcgttcttttgccgaggcttctatggcaactgctttagagaaaaagtggccactttatcttagcaccaaaaatacaattctcaagaaatatgatggaagattcaaggacatatttcaagaagtttatgaggcaagctggaaatcaaagtttgaggctgctggtatatggtatgagcatcggctcattgatgatatggtggcgtatgcacttaagagtgaaggaggttatgtatgggcttgcaaaaactatgatggagatgtccagagtgatttcttagctcaaggttttggatcactaggtttgatgacatctgtattggtttgccctgatggaaagactattgaagcagaagcagctcacggcacagttacccgtcattttagggttcatcagaagggaggtgaaaccagcacaaatagcatagcatccatctttgcctggacaagagggctagcccacagggcaaaactggacgacaatgccaaactcttggatttcactgaaaaactagaggcagcttgcattggagtagtagaggctgggaagatgaccaaggatttggcacttattcttcatggatccaagctttcaagggagcattatttgaacacagaggaattcattgatgccgtggcagccgagcttagtgctaagctttctacatagacttgatttaagacaggcggaaaagaagacgatagcaacaaggagcgtgcgtgcgtgcgtatgctgctctctatattcagaagaaataagaaagggaaaaagaagcattggtccttaccttagccccttttccttcatttgtttgttggttgggagagcaagggttgactgtttcttctccatattggttgtgaactgatttgtcctttgtattttctaactgatcccttccaacttccaatttttataattggattttctgctgaatttatttttttccatgtttttgacttattatttttctgcaaatgccgtgctgcagacagaaaaggtgaacatccttccgaatctttagtgggtcaccataatccataatagatacagcatggccaca

SEQ ID NO: 1712 - DNA, 1979 bp, Glycine max
ataatgtgttgtctagcattattgatcgtttgtgtgggtgtgtctgttttcgttgtttcccactttccaaatcacatccaacgtgaatccgtcattcaacttgattgaagtacacactaaccttactgagtgtgttcattgggaactggttcattccacacattttatttaagccaaaaaaacccacaatttctcttagtgtgtgcttttttgttgaaattgttgtttcttcctctgagttccaactttcacctcagccaaatacacaacaaaatggggtttcagaagataagggtgggcaaccccatcgtcgaaatggatggggatgaaatgacccgagtgatttggaaactgataaaagataagcttattttcccttatttggagctggatattaagtattttgaccttggccttcctcatcgcgatgccactaatgatagagttactattgaaagcgctgaagctacactcaagtataatgtagctatcaaatgtgctactataactccagatgaagctcgtgtcaaggagtttaacttaaaacaaatgtggagaagtccaaatgggacgatccgaaacattttaaatggtacagtttttagagagccaattatctgtaagaacattcctcgtcttgtttcaggatggacaaagccaatatgcattggaagacatgcttttggagaccaatatcgggcaactgatacagttataaaaggcccaggaaagctaaaattggtttttgcacccagtggaaatgaaggcattaaagagctagaggtctataactttactggtgctggaggcatagctttgtccatgtataatactgatgagtccattcgagcttttgctgaggcttcaatgaactttgcttaccagaagaaatggcctctctatcttagcactaaaaataccattttaaagaaatatgatggaagattcaaggacattttccaggaagtttttgacacccaatggaatcacaagttcaaagctgcagggatatggtatgaacaccgtcttatagatgatatggttgcttatgctctcaaaagtgatggaggttatgtatgggcctgcaagaattatgatggtgatgtgcagagtgatttcttagctcaaggatttggttcacttggcttgatgacgtcagtactggtttgcccagatgggaaaaccattgaagcagaggcagcccatggcactgttacccgtcattatcgggttcatcagaagggaggtgaaaccagcacaaacagtattgcttcaatttttgcctggtcgcgaggtcttgcacatagggcaaaattggatggaaatgctagattgttggacttcacagagaaactggaagcagcttgcattggaacagttgaattgggaaagatgacaaaggatcttgcacttcttgttcatggacctaaggtttctagatcccagtatttgaatactgaagagttcattgatgccgtagccgaggagctgcgaacaagattatcttcacaatcgaagctgtaaagttcaagatgaatgtatccaataaatgttctccatttccttcatttttcctttttctttcttgaaggagggaaattctattgcttgagttaaacattttagagcaataaggtcaccaaaattctgatgcatcacttattgcatgttgcttccttcagccataagaactcaacatttgaagaactcataccatgtaccacaaaatcaatactatcttttcattgtcaaaacaacagtgctactttggaagtccttacaacaatattaaagacattgtaaaaaaaaatagggaaaaaaagcatcttcgaatgaatttacatgtctgtttacaatctatatttctcagggatgtcttcaattttctttagggaaagaggaggtggaggcgacagtttgtactgtatattcttgtcaaagaaatatattttttaacagaatatatgacttttactact

SEQ ID NO: 1713 - DNA, 1783 bp, Glycine max
tcctctctgagttccaactttcacctcaaccaaatacacaacaaaatggggtttcagaagataagggttggcaaccccatcgtcgaaatggatggggatgaaatgacccgagtgatttggaaactgataaaagataagcttatttttccttatttggagctggatattaagtattttgaccttggccttcctcatcgcgatgccactaatgatagagttactattgaaagtgctgaagctacactcaagtataatgtagctatcaaatgtgctactataactccagatgaagctcgcatcaaggagtttaacttaaagcaaatgtggagaagtccaaatgggacgatccggaacattctaaatggtacagtttttagagagccaattatctgtaagaacattcctcgtcttgtttcaggatggacaaagccaatatgcattggaagacatgcttttggagaccaatatcgggcaactgatacagttataaaaggcccaggaaagctaaaattggtttttgcacccagtggaaatgaaggcattaaagagctagaggtctataactttactggtgacggaggcatagctttgtccatgtataatactgatgagtccattcgagcttttgctgaggcttcgatgaactttgcttaccagaagaaatggcctctctatcttagcactaaaaataccattttaaagaaatatgatggaagattcaaggacattttccaggaagtttttgacactcaatggagtcacaagtttaaagctgcagggatatggtatgaacaccgtcttatagatgatatggttgcttatgctctcaaaagtgatggaggttatgtatgggcctgcaagaattatgatggtgatgtgcagagtgatttcttagctcaaggatttggttctctcggcttgatgacatcagtactggtttgcccagatgggaaaaccattgaagcagaggcagcccatggcactgttacacgtcattatcgggttcatcagaagggaggtgaaaccagcacaaacagtattgcttcaatttttgcctggtcacgaggtcttgcacatagggcaaagttggatggaaatgctagactgttggactttacagaaaaactggaagcagcttgcattggaacagttgaattgggaaagatgacaaaggatcttgcacttcttgttcatggacctaaggtttctagataccagtatttgaatactgaagagttcattgatgctgtagccaaggagctgcaaacaagattatcttcacaatcgaagctgtaatgttcaagatgaatgtgcccaataaatgttctccatttcctttcttgaaggaggggaattctattgcttttgagttaaacattttaaagcaatacctttaaggtcaccaaaattctgatgcatcactgattgcatgttgcttccttcagccataagaactcaacatttgaagagctcatgtcatgtataccacaaactcaataatatcttttcattgtcaaaacagcagtgctactttgaaggtcctcacaacaatattaaagacattaaaacatagggagaaagagtgtcttcaaatgaatttacatgtctgtttacaatgtttatttctcagagatgtcttcaattttctttagggaaagaggtggaagcaacactttgtactgtatattcttgtcaaagaagtatatttttaactgagtatatgacttttactactaaaaatactcgaaatgtatgtaagatcgatcaccaaaattctaatgca

SEQ ID NO: 1714 - DNA, 1907 bp, Glycine max
gaggctactgaaatcattacttatactagttttctacgattattcatagtgaggcaatagtagcagcaattcacactggtctttgcttctcgttactcatttctcacctaactttctattcttctcagtctcagatcagaaccttagccatggcagcgttccagaagatcaaggtcgccaaccccatcgtcgagatggacggagatgaaatgactagggttatctggaagtcaatcaaggacaagctcattttgcccttcttggagttggacatcaagtattatgacttaggccttccttaccgtgatgagaccgatgataaagttacaattgaaagtgcggaagcaactctcaagtataatgtggcaattaagtgcgcaactattactccagatgaagctcgtgtgaaggagtttggtctgaagtcaatgtggaagagtccaaatgggacaattaggaacattttgaatggaactgtcttcagagaaccaattctttgcaaaaacattccccgccttgttcctggttggacaaaggcaatatgcattggaagacatgcgtttggtgatcaatatcgggcgactgacacagtaattaaaggagctggaaagctgaagctggtgtttgttccagaaggccagggtgaggagactgaattcgaggtttttaacttcactggtgaagggggtgtttcattggctatgtacaatactgatgagtctattcgttcttttgctgaggcctctatggcaactgctttagagaaaaagtggccactttatcttagcaccaaaaatacaattctgaagaaatatgatggaagattcaaggacatatttcaagaagtttatgaggcaagctggaaatcaaagtttgaggctgctggtatatggtatgagcatcgactcattgatgatatggtggcgtatgcacttaagagtgaaggaggttatgtatgggcatgcaaaaactatgatggagatgtccagagtgatttcttagctcaaggttttggatcactgggtttgatgacatctgtattggtttgccctgatggaaagactattgaagcagaagcagcccacggcacagttacccgccattttagggttcatcagaagggaggcgaaaccagcacaaatagcatagcatccatctttgcctggacaagagggctagcccacagggcaaaactggatgacaatgctaaactcttggatttcactgaaaagctagaggcagcttgcattggagtagtagaggctgggaagatgaccaaggatttggcacttattcttcatggatccaagctgtcaagggagcattatttgaacacagaggaattcatcgatgccgtggcagccgagcttagtgcgaggctttctgcatagacttgattcaagacaagcggaaaaaagacgttagcaacaaggagcgtgcgtgcgtctgctactctcttctattcagaagaaataagaaagggaaaaaaagcattggtccttagccccgtttccttcatttgtttgttggttgggaatgcaagggttggctgtttcttctccataatattggttgtgaactgatttgtcctttgtaatttcttattgatcccttccaactcccaatttataatggattttctgctgaatttattttgcatgttttgacttattattattctgcaaatgccgttctgcagatagaaagttaaacatccttcccaatctttagtgggtcaccataataagtaccacatggccagcaaagtatgtaacttctaagagccaactaactaacctctttcttgttcaggggttatattagattgagattttaaagattattttataggaaaaaatcagttttatgataatttaaattttaatgaatttatgatttttttttat

SEQ ID NO: 1715 - DNA, 1524 bp, Selaginella moellendorffii
cctaaagtgtgttctttggatctattttgttcctccgccctcctccctccagctcgccgccgccggcaagagcgtcgcatccgccggcgccatcgccatcgccatcgcctgtagaagcgcagaagcgcaagatccgaatggcgttcgagaagatcaaggtggagaatcccatcgtggagatggacggagatgagatgacccggatcatctggcaaatgatcaaggacaagctcatttttccattccttgatttggatattaaatactttgacttgggccttccacgtcgtgacgaaactgatgacaaagtcacagttgagagtgccgaagcaaccctcaagtacaatgttgcgatcaagtgtgcaacgatcacgccagacgaagctcgagtcaaggaattcggcctcaaggcaatgtggaaaagtcccaatgggacaattcgtaacattttgaacgggactgtttttagagagccgattgtctgcaagaacgtcccgaggcttgttccagggtggacgaaaccaatttgcattggaaggcatgcttttggagaccagtatcgtgccaccgatacagttatcaagggctctggaaagcttaagctggtttttgtgcctgagaatggagaggcctctgaattcgaggtttacgacttcaagggagatggaggagtcgctctttctatgtacaacactgatgagtccattcgttcctttgcacaagcctctatgactactgctctggcaaagaagtggcctctatacttgagcaccaaaaacacgattttgaagaagtacgatggcaggtttaaggatatcttccaagaggtctacgaggcggagtggaagagcaagtttgaggaagctggcatctggtacgagcatcgcctgattgacgatatggttgcttatgctctcaagagcgatggtggatatgtctgggcatgcaaaaactacgatggtgatgtgcagagcgactttttggcacaaggatttggttcccttggattgatgacttctgtgctggtctgccccgatggaaagaccattgaagccgaagccgctcatgggactgtaactcggcactacagagtacaccagaaaggcggtgaaaccagcaccaacagcatcgcctccatctttgcctggtctcgaggcctttctcacagggcgacactggatggcaatgcgcggctaagcgactacgcagagaagctcgaggcggcttgcgtaggaatcgttgagtctggcaaaatgacaaaggatctcgctctgctcatccacgggccaaaggtgacaaagaaagattatcttaacaccgaggagtttatcgatgccgtggctgccgatcttaagctcaggctgacaaccgcgccgtccaaattgtaaagccggctcccgatttctcaggaagcgtgagcaaacacggctggaaattctaatttttttacgatccatccggacaatttccctcaaataatataaacttaaaataattattaacaaggacatttgtttccgggct

SEQ ID NO: 1716 - DNA, 1348 bp, Selaginella moellendorffii
agaatcccatcgtggagatggacggagatgagatgacccggatcatctggcaaatgatcaaggacaagctcatttttccattccttgatttggatattaaatactttgacttgggccttccacatcgtgacgaaactgatgacaaagtcacagttgagagtgccgaagcgaccctcaagtacaatgttgcgatcaagtgtgcaacgatcacgccagacgaagctcgagtcaaggaattcggcctcaaggcaatgtggaaaagtcccaatgggacaattcgtaacattttgaacgggactgtttttagagagccgattgtctgcaagaacgtcccgaggcttgttccagggtggacgaaaccaatttgcattggaaggcatgcttttggagaccagtatcgtgccactgatacagttatcaagggctctggaaagcttaagctggtttttgtgcctgagaatggagaggcctctgaattcgaggtttacgacttcaagggagatggaggagtcgctctttctatgtacaacactgatgagtccattcgttcctttgcacaagcctctatgactaccgctctggcaaagaagtggcctctatacttgagcaccaaaaacacgattttgaagaagtacgatggcaggtttaaggatatcttccaagaggtctacgaggcggagtggaagagcaagtttgaggaagctggcatctggtacgagcatcgcctgattgacgatatggttgcttatgctctcaagagcgatggtggatatgtctgggcatgcaaaaactacgatggtgatgtgcagagcgactttttggctcaaggatttggttcccttggattgatgacttctgtgctggtctgtcccgatggaaagaccattgaagccgaagctgctcacgggactgtaactcggcactatagagtacaccagaaaggcggtgaaaccagcaccaatagcattgcctccatctttgcctggtctcgaggcctttctcacagggcctcactggatggcaatgcacggctaagcgactacgcggagaagctcgaggcggcttgcgtaggaatcgttgagtctggcaaaatgacaaaggatctcgctctgctcatccacgggccaaaggtgacaaagaaagattatcttaacaccgaggagtttatcgatgccgtggctgccgatcttaagctcaggctgacaaccgtgccttccaaattggaagcctgagcaaacacggctggaaattctattttttttactatccatccggacaatctccctcaaataacttcgttcttatatacttaaaaataattattaacacggacatttgttttcgggcc

SEQ ID NO: 1717 - DNA, 1807 bp, Picea glauca
atctctttcgctctttctaaatcgatttttggcgatttcgaatctttcgttgaatcgcggttttggatccgtaggtccgcgagttcgtctcggatcggttcccgtccttctttgtcttcgatcgttctctgctgttacaatggcgtcggagaagatcaaggttcagaatccgatcgttgagatggacggggatgaaatgaccagggtcatctggacaatgatcaaggacaagcttattttcccttttgtagagctggatattaagtattttgatctggggctcccccaccgtgatgctacagatgacaaggttacagttgagagtgcagaggccacattgaagtacaatgttgccatcaagtgtgcaaccatcacaccagatgaagctcgagtcaaggaatttggcttgaaggctatgtggaagagtcccaatgggactatccgtaacattttgaatggtaccgtgttcagagagccaattttgtgtaagaacgttcctaagcttgttccaggatggacaaaacccatatgtattggaaggcatgcttttggtgaccaatacaaagcaacagatacagttatccagggccctggcaagctgaaattagtttttgttccagagaaaggtggtgaaacaactgagttagaggtgtacaactttaaaggtgatggaggagtagcattagccatgtacaatactgatgagtctatacgttcatttgctgaggcttcaatggccgtggccttggagaagaaatggccactctaccttagtacgaaaaacacaattttgaaaaaatacgatggaaggttcaaagacattttccaagaggtctatgaatccaactggaaaactaaatatgaagaagcaggaatctggtatgaacataggcttatcgatgacatggtagcctatgctttaaagagtgaagggggctatgtttgggcgtgcaaaaattatgatggtgatgtgcagagtgatttcttggcacagggatttggatcccttggcttgatgacgtctgtactggtttgtcctgatggaaaaactattgaggctgaagcagctcatggcactgttactcggcatttccgtgtacatcaaaagggaggtgaaactagcacgaacagcattgcctctatctttgcatggacacgcgggcttgcacacagggcaaaactggacggaaatgcaaggctacttgaattttctgagaagttggaagttgcttgtataggaactgttgaggccggaaaaatgacaaaagatttggcactaatcattcacggttccaagctttcgagggagcactacctaaacactgaagaatttattgacgcagttgcagaggatctgaaaataagactttctgccaaacccaagttgagttcttaagggattgtgaaatgtgtggcgattgagcctgcaagagttgtttgaagtagtaggtcagtcggctactaggggaaatgtagaaggcccatggaatatctgttgtggcatttgaaaggcaaaacattggctgttttcaattttaaaatttacatttgcgatagtcattgttatatttcgagggactctttcctcttatgattgttagaaatgttaatgctctgatacagaagtctctaatcatttatcatgggctatgtatgtgcgactagacatgcacacaactagaataaatattgttttaactggaaactcttcaaaatagctagcagtcagcaaaattgtttcttagcatgaaaaaatgtatgcagtgtaatttaaccctgcacatataccctctattgaatggattca

SEQ ID NO: 1718 - DNA, 1336 bp, Fragaria vesca
aaaaaaaccagcgagcgactctgagccttgcttgtcccaatcactcaatggcgttcgagaagatcaaggtcgctaaccccatcgtcgagatggacggagatgagatgactcgaattttctggcaatcaatcaaggataagcttattttgccctttttggatttggatatcaagtactttgatctcggtcttactcaccgtgatgccactgatgacaaagttaccattgaaagtgcggaggctactcttaagtacaacgtagcaatcaaatgtgcgactatcacaccagatgaagctcgcatgaaggagtttaacttgaagcaaatgtggaggagtcccaatgggactattaggaatattctgaatggtactgttttcagagaaccgattctttgcaagaacattcctcgtctgatcccaggttggacgaagccaatatgcattggaagacatgctttcggtgatcaatatcgagcaactgatacagttatcaaaggacctgggaagctgaaattgatgtttgttccagagggacaggatgagaagatggaattcgaagtattcaactttacaggggaaggcggagtagcaattgccatgtacaacactgatgagtcaatccgtgcttttgcagaagcttctatgaacacagcttatgagaaaaagtggcctctttatcttagcacaaaaaacactattcttaagaagtatgacggaagattcaaggacatatttcaagaagtatatgaagcccactggaaatccaagtatgaagctgctggcatatggtatgaacatcgtctcattgatgatatggtggcttatgcacttaaaagcgaaggtggttatgtttgggcatgcaagaactatgatggagatgtgcaaagtgatttcttagctcaaggttttggatctcttggattgatgacatctgtactggtgtgcccagatggaaagaccatagaagctgaagctgcccatggaacagttactcggcattatagagttcaccagagaggtggtgaaacaagcacaaacagcatagcttctatttttgcttggacaagagggcttgcacacagggcaaagttggatgacaacgctaaattgttggaattcactcagaagctgggagaggcatgtattggaactgtggaatctgggaaaatgaccaaggatcttgcccctaattcttcatggacctaagcttgctaggaaacactacttgaacacaaaaaaattctttgaagcccgtggcttccgaactgaaaacaaagctttttttaaagccctaattaatcggggcaattggtgctttttggtttccgaaaaaaaaa

SEQ ID NO: 1719 - DNA, 1657 bp, Saccharum officinarum
taaaaaccctcccactccattgatgatgatcccccgttccttccgtcgtcttctcctccccagcacacccaccagtcccgtccggccgccggctgtctcgcccgtcgccgccctctcccggtccctgaagcgaaccagatcggccatgacgttcaacaagatccaggtcgccaacccggtcgtcgagatggacggcgatgaaatgaccagggtgttctggaaatctatcaaggacaagcttatcttccctttcgtggacctggacatcaaatactttgacctcggccttccataccgtgatgctaccgacgacaaagtcacagtcgaggctgcggaggccacactcaagtacaatgtggctatcaagtgtgccaccattacaccagatgaagcaagggtgaaggagtttggcttgaaggctatgtggaagagcccgaatggcacaattaggaatattctgaatggcactgtgttcagagaaccaatcatctgtaaaaacatcccacggcttgttccaggctggacaaagcccatttgcattgggaggcatgcgttcggtgatcagtaccgggcaactgatgcagttatcaagggacctggcaagctcaaattagtttttgagggaaaagaagagcaagttgagctggaggtgttcaacttcactggtgccggaggagttgccctatccatgtacaacactgacgagtccatccatgcctttgctgaggcttctatggccactgcttatgaaaagaaatggccattgtatcttagcaccaaaaacactattctgaagaaatatgatggcaggttcaaggacattttccaggaggtgtatgaagctggttggaaaaccaaatttgaagctgccggcatatggtatgagcatcgcctcattgatgacatggtagcatacgcgcttaagagtgaaggagggtatgtctgggcttgcaagaattatgatggagatgtgcagagcgatttcttagctcaaggttttggctcattgggtttgatgacatcggtactggtgtgccctgatggaaagacgatcgaagctgaagctgcccatggtactgttacccgtcattatcgtgttcatcagaaaggaggtgaaaccagtacaaacagtattgcctcaatctttgcgtggacaagaggacttgcacacagggcaaagcttgatgacaatgctagactacttgacttcactcagaagcttgaggctgcctgcattggagctgtcgagtctgggaagatgaccaaggaccttgcccttcttgttcacggatctgcaaatgtcacgaggagccattacctgaacactgaggagttcatcgacgctgttgctgatgagctcagatcaaggctggcggccaactcaaacttatgaaatccttgctgaagttctgatgcttccctgcatgatgattcagagtcatttttcttatgtcgccattatctttccttgtgccaccaccctgaaggcctgaactaggggaatatctgcaggctgcagcagtatgccagatcattaccaatgagagattgtcctagattccgcgattatggaactcatatacctgattatctgatacattttaggtttttaaaaaatatctgatacatttcaataaaaaggccgtccattcagaaa

SEQ ID NO: 1720 - DNA, 1648 bp, Saccharum officinarum
  misc_feature (521)..(521): n is a, c, g, or t
cggagcaaccctccggtttcgttaaatccgctcgcatactctcttcccctctctcttcttccttccttccacaggcgccgccgcaacctgccccttcccgatctccgaggcaaagctgcgaccccgccaacgccgccatggcgttcgagaagatcaaggtctccaacccaatcgtcgagatggacggtgatgagatgaccagggtattctggcagtctatcaaggacaagcttatttttccatttcttgatctggacatcaagtactatgatttggggatactgcaccgtgatgcaactgatgacaaggtcacagtggaggctgccgaggctactctcaagtacaatgtggctattaagtgtgcgacgattactccagatgaaactcgggttaaggagttcaatctgaagcacatgtggaagagcccaaatggcacaattaggaacattataaatggcactgtgttcagagaacctattatatgcaaaaatgttccaaggcttgtaccaggatggactaancccatctgcattggaaggcatgccttcggtgatcagtaccgagctactgatgcagttctgaaggggcctgggaagctgaagctagtttttgaaggaaaagaagaacagattgatctggaggtgttcaacttcactggtgctggaggagttgccttgtctatgtacaacactgatgagtcaattcgagcttttgccgaggcttctatgacaactgcttatgagaagaaatggccgctctaccttagcaccaaaaacacaatcctgaaaaaatatgatggcaggtttaaggacattttccaggaggtctatgaagctggctggaaatccaaatttgaggctgctggaatatggtatgagcatcgtcttattgatgacatggttgcgtatgcgcttaagagtgaaggaggctatgtgtgggcttgcaagaactacgatggagatgtgcagagtgatttcttagctcaaggttttggctctttgggtttgatgacatcagtgttggtgtgccctgatggaaaaaccattgaagctgaagctgcccatggcacagttacccgtcatttccgtgttcaccagaaaggaggtgaaaccagtacgaacagcattgcttcaatctttgcatggacaagaggacttgcacacagggcaaagctggatgacaatgctaggctactcgacttcgctctcaaactcgaggctgcttgtgttggaactgtggagtctgggaagatgactaaagatcttgcacttcttgttcatggatcttccaacgtcacaaggagccattacctgaacactgaagagttcatcgatgcagttgctactgagctccgatcaagattgggagccaattgagcttacaagaaactttgcatcgcgacttgaatgcttcatcaccgatctgctctcgtcatttttgttacatttgtattgccagtcatgcttccgtgatgaagtgaatgtgcgtcaccgcaatttcgatccaagctaattaaagatgattgtcacgtgagtgcccaaaataaaggatatatagaacaatggtcgcagatgattaaattacttttatgtttactaagttcatgttgtatccgaaaaacaaaaacaaacaagcccaacacacaaaa

SEQ ID NO: 1721 - DNA, 1702 bp, Helianthus annuus
  misc_feature (128)..(128): n is a, c, g, or t
  misc_feature (132)..(132): n is a, c, g, or t
  misc_feature (137)..(137): n is a, c, g, or t
  misc_feature (363)..(363): n is a, c, g, or t
ggtcattaacctaacccttttttaaatatttatctgtaattattagttagcctaaattcaacaatggcaaccgcatcgtaatagtactatgttaaaatattgccatcccaaccccacctaccattcgnattnggcantcgccgtcctataaatatcccaaaccctcactccgtcactatctcaccatctttctcactccgatctccggcaaacttttctccggcgatctcatcgttcgttcagaagcagtagcaatgtctttcgccaaaatcaaagtcgaaaaccccatcgttgagatggacggagatgaaatgactcgtgtcttttggcaatcaatcaaggataagctcattttccccttcntagatctcgacattaagtattacgacctgggtcttcctaaccgtgacgctactgacgataaagttaccatcgaaagtgccgaagctactcttaagtacaatgttgcgattaagtgcgccaccattacccctgatgaggctcgtatgaaggagttcactttgaaaagcatgtggaagagtccaaacgggacgatcagaaatatattgaacggcacagtttttagagaaccaattctttgcaaaaatattcccaaactagttccaggatggacaaagcctatttgcatcggaagacatgcatttggtgatcaatacaaagctaccgatgcagtgattaagggacccggaaagcttaagcttgtttttgttcccgaaggagaaggtgaaaacatagacttggaagtttacaacttcactggtgctggaggggtagctttgtcaatgtacaacactgaagagtccattgccgcttttgctgaggcctcgatgaacacagcttatcagaagaagtggccactttatcttagcacaaagaacactattctgaagaaatatgatggaagattcaaggacatatttcaagatgtttatgaaagcaactggaagtcgaagtttgaggctgctggaatatggtatgaacaccgtctcatcgatgatatggttgcttatgctcttaagagtgatggaggttatgtatgggcatgcaaaaactacgatggtgatgttcaaagtgatatgttggctcaagggttcggatcacttggattgatgacatcagtcttggtttgccctgatgggaagaccattgaatccgaagcagctcacggcactgtaactcgtcattacagagtgcatcaaaagggaggtgaaactagcactaatagtatagcctcaatctttgcttggacccgaggactggcccacagggcaaagttggacaacaacgctaagcttttggatttcactgagaagctggaagccgcatgtatcggaactgttgaatccggaaagatgacaaaggatcttgcactcattattcatggatccaagctcagtagggagcactatttgaacaccgaagaatttatcgatgctgtagccgatgagctgaaagcaagacttgtgggcaaatcatcactgtaagtgcatgatgagcagttgagagtaatgactggaccaagaagatttatgttcattgttccatgtgtttggttgaattcagcacaccattattgatatattggtggttattttaagaatttatattatgcttttttgtttaatctgggaacctgatttgatcagtttcagtttgaatggaatggaagtttttatatttg

SEQ ID NO: 1722 - DNA, 1847 bp, Helianthus annuus
  misc_feature (1039)..(1039): n is a, c, g, or t
  misc_feature (1724)..(1724): n is a, c, g, or t
  misc_feature (1792)..(1792): n is a, c, g, or t
acaacgatgtgcataacgccgggcccgaggtggttttatgagcccgtgtttccatgcccgcaccgtttggtattagtgtgactacgggttaatgtgttagttgttgagtggagcccagcaccaccaccggcttctccaatataaaaatctcgattttctgcatttctttgccctcaccaactccactccgtctctgtcttcatagttgccgtttcttactctccgacttcggttgccagccggagcttcttttattagcgcacacacaaatctccaatcgtgaatcatggctttcgagaagatcaaggtcgctaatcccatcgttgagatggacggagatgaaatgactcgtgtcttttgggaatcaatcaagaataagctcatctttcctttcttagatctggacataaagtattatgaccttggccttcttaaccgtgacgccactgatgataaagttactgtagaaagtgctgaagcgactctaaagtacaatgttgcaattaagtgcgccaccattactccagatgaggctcgtatgaaggagtttactttgaagagcatgtggaagagtccaaatgggaccatcaggaatattttaaacggcacagtttttagggagccaattctctgcaaaaacatccccaggctgataccaggatggacaaaggcgatatgcattggtaggcatgcttttggtgaccagtacaaagctactgatgcagtgatcaaaggacctggaaaactgaagatggtatttgttcccgaaggagaaggtgaaaacaccgagttggaggtttataacttcactggtgctggtggggtagctttgtcaatgtacaacactgatgagtccattaccgcttttgctgaggcctcaatgaacacagcctacttgaaaaaatggccgctttatctaagcacaaagaataccattcttaagaagtatgatggaaggttcaaggatatcttccaagaagtttatgaacgtaactggaaatcaaagtttgaggctgctggcatatggtatgaacaccgnctcattgatgacatggttgcttatgctcttaagagtgatggaggttacgtatgggcatgcaaaaactatgatggggatgtccaaagtgatatgttagctcaagggtttggatctcttggattaatgacatcagtcctggtgtgtcctgatgggaagaccatagaatctgaagcagcccatgggacggtgacacgtcattacagggtgcatcaaaagggtggggaaaccagcacaaacagcatagcctctatttttgcttggacccgaggccttgcccacagggcaaagttggatgacaatgcgaagcttctggatttcactgaaaaattagaagcagcgtgtatcggttgtgttgaatctggcaaaatgactaaggatcttgcacttatcatccatggatctaagctgagtagggagcattatttgaacactgaagagttcattgatgccgtcgctgatgagctcaaagctagactctcgagcaaataatcattatgattgcttcatggtgagtcggtttcaaagattctgaagtcgatctgctatgatatttgggggtctctctttgccaaacaagtttcaagatttactggttatcatgacatatattgtcatgttatctgcttttcaatctcgtatgttgttttccgactgttgtcgatttctgtatctctttctattaaanattattattgcaaaggaaatgctgtttgtgaagaggaatttggaaaactggagtgggtcgaatcgggncgtcatggaccgaaccttttgaagtaataacagaccagcccatgatcagtcaaaa

SEQ ID NO: 1723 - DNA, 1780 bp, Panicum virgatum
tctctctctgcctcctcccgcaagcgccgccgccgcctcgcccctcccgatctccgaggcaagctgcgacgccgccgccgcggccatggcgttcgagaagatcaaggtcgccaaccccatcgtcgagatggacggcgatgagatgaccagggtattctggcagtctatcaaggacaagcttatcttcccatttttggacttggacatcaagtactatgacttggggattctacaccgtgatgcaactgatgacaaggtcaccgtggaggctgcagaggctactctcaagtacaatgtggctattaagtgtgctaccattaccccagatgaaactcgggttaaggagttcaacctgaagcacatgtggaagagcccaaatggaacaattaggaacattataaatggtactgttttcagagagccaattatttgcaaaaatgttccaagacttgttccaggatggactaagcccatttgcatcggaaggcatgctttcggtgatcagtaccgggctactgatgctgttctgaaggggcctgggaagctcaagctagtttttgaggggaaggaagagcagatcgatctggaggtattcaacttcactggtgctggaggagttgccttgtctatgtacaacacggatgagtcaattcgagcttttgctgcggcttctatgacaactgcttatgagaagaaatggccgctctaccttagcaccaagaatacaatcctgaagaaatacgatgggaggtttaaggacattttccaggaggtctacgaagcagactggaaatccaaatttgaggctgctggaatatggtatgaacatcgtctgatcgatgacatggttgcatatgcgcttaagagtgaaggaggctatgtgtgggcttgcaagaactatgatggagatgtgcagagtgatttcttggctcaaggttttggctcgctgggtttgatgacatcagtgttggtgtgccctgatgggaaaaccatcgaagctgaagctgctcatggcacagttacccgccacttccgtgttcaccagaaaggaggtgaaaccagtacgaacagcatcgcttcaatctttgcttggacgagaggacttgcacacagggcaaagctcgatgacaatgataggctacttgactttgcactcaaactcgaggctgcctgtgttggaactgtggagtctgggaagatgacaaaagatcttgcacttcttgttcacggctcttccaacgtcacgagaagccattacttgaacactgaagagttcattgatgccgttgctgctgagctccaatcaaaactggcagccaattgagcttacaggaagcttttggcaaatttagtgcttcaccacccaccactactaagtcatttcggctacattagcattgttattcacgcttcgcaatggagtgaatgtgccttctgccatttggatgtaagctaattcaagatgctactagtgttatgcgcgctctgaataaaggacatagagttggccagtgctgtgattaggttaccagcaataagctccatcgtatttgtggagatgtgtcttgttttctcctttgaattgcatggcttcttcgtcgttcaccaatcatcagtttttctactgtgtttaggaggcagtaaagggtccttcgtcaaccataattaaatgtggggaaaaaatgatcaatatgctgagttgtaagctctaaagcatgaagtgtgtgattgatgccactttccatggtaccaatgtttcagtctgctgctatcagttcgt

SEQ ID NO: 1724 - DNA, 1573 bp, Panicum virgatum
cttcctctccaagacagtcaccaatcctaccgcgctacctgtctcgccggctcgccgcccccgtcccgcccccctccaggccggccatggcgttcaacaagatcaaggtcgccaaccccgtcgtcgaaatggacggcgatgagatgaccagagtgttctggaaatctatcaaggacaagctgatcttcccgttcttggacttggacatcaaatactttgaccttggacttccacaccgtgatgctactgatgacaaagtcacagtggaagctgcggaggccacactcaagtacaatgtggctatcaagtgtgccacgattacaccagacgaagcaagggtaaaagagtttggcttgaaggccatgtggaagagcccgaatggcacaattaggaacattctgaatggcactgtgttcagagaaccaatcatctgcaaaaacatcccaaggcttgttccagggtggacaaaacctatttgcattggaaggcatgcattcggtgatcagtaccgggcaactgatgctgttatcaagggacccggcaagcttaaattagtttttgagggaaaagaagagcaagtcgagctggaggtgttcaactttactggtgctggaggagttgcattgtccatgtacaatactgacgagtccatccatgcctttgctgaggcttccatggccactgcttatgagaagaaatggccattgtaccttagcactaagaatacaattttgaagaaatatgatggcaggttcaaggacattttccaggaggtgtatgaagctggatggaaatccaaatttgaggctgccggcatatggtatgagcaccgccttatcgatgacatggtagcatacgctcttaagagtgaaggagggtatgtctgggcttgcaagaattatgatggagatgtgcagagcgatttcttagctcaaggttttggctcattgggtttgatgacatcagtattggtgtgccctgatggaaagactatcgaagctgaagctgcccatggtactgttacccgtcattaccgtgttcaccagaaaggaggtgaaaccagtacgaacagcattgcttcaatctttgcgtggacaagaggacttgcacacagggcaaagcttgatgacaatgctagactgcttgacttcactcagaagcttgaggctgcctgcattggagctgttgagtctgggaagatgaccaaggaccttgcccttcttgttcatggatcttcaaatgtcacgaggagccattacctgaacaccgaagagttcatcgacgcggttgctgatgagctcagatcaaggctggcggccaactccaacttatgaaatctttgctgaagctgcaatgcttacttggacgacgattcgagtcatttttcatacatcaccattttctttccttggcgccccagtcctgaaggcctgaactgaacgggaatatcctcagtagtgtcacagatcattaccaatttgagattgccctggattccgcgattacgcaactcatgtacctgattgcccattattttcaataaaagataaagaacttgtgtccattcagaatg

SEQ ID NO: 1725 - DNA, 1577 bp, Panicum virgatum
aagacaaacaccaatccgaccgcgccgcttggctcgccggctccgccgcccccgtaccctccctccaggccggccatggcgttcaacaagatcaaggtcgccaaccccgtcgtcgagatggacggcgatgagatgaccagggtgttctggaaatctatcaaggacaagctgatcttcccgttcttggacttggacatcaaatactttgaccttggacttccacaccgtgatgctactgatgataaagtcacagtggaggctgcggaggccacactcaagtacaatgtgtctatcaagtgtgccacgattacaccagacgaagcaagggtaaaggagtttggcttgaaggccatgtggaagagcccgaatggcacgattaggaacattctgaatggcactgtgttcagagaaccaatcatctgcaaaaacatccccaggcttgttccagggtggacaaaacccatttgcattggaaggcatgcattcggtgatcagtaccgggcaactgatgctgttatcaagggacctggcaagcttaaattagtttttgagggaaaagaagagcaagtcgagctggaggtgttcaactttactggtgctggaggagttgcattgtccatgtacaacactgacgagtccatccatgcctttgctgaggcttccatggccactgcttatgagaagaaatggccattgtaccttagcaccaagaatacaattttgaagaaatatgatggcaggttcaaggacattttccaggaggtgtatgaagctggatggaaatccaaatttgaggctgccggcatatggtatgagcaccgccttatcgatgacatggtagcatacgctcttaagagtgaaggagggtatgtctgggcttgcaagaattatgatggagatgtgcagagcgatttcttagctcaaggttttggctcattgggtttgatgacatcagttttggtgtgccctgatggaaagacgatcgaagctgaagctgcccatggtactgttacccgccattaccgtgttcaccagaaagggggtgaaaccagtactaacagcattgcttcaatctttgcgtggacaagaggactagcacacagggcaaagctcgatgacaatgctagactgcttgacttcactcagaagcttgaggctgcctgcattggagctgttgaatctgggaagatgaccaaggaccttgcccttcttgttcatggatcttcaaatgtcacgaggagccattacctgaacaccgaagagttcatcgacgcggttgctgatgagctcagatcaaggctggcggccaactccaacttatgaaatccttgctgaagctgcaatgcttacttggacagacgattcgagtcatttttcatacattaccattttctttccttggtgccccaatcctgaaggcctgaactgaacgcgaatatccccagcagtgtgtcgaatcattaccaatgagagattgctgtggattccacgattatgcaactcatgtactgatgtacctgattgcccgttattttcaataaaagataaagaacttgtgtccattcagaatggtttct

SEQ ID NO: 1726 - DNA, 1726 bp, Panicum virgatum
tctctctctgcctccttccgcaagcgccgccgccgccccgccccgccccgcccctcccgatctccgaggcaagctgcgacgccgcggcggcggccatggcgttcgagaagatcaaggtcgccaaccccatcgttgagatggacggagatgagatgaccagggtattctggcagtctatcaaggacaagcttatcttcccatttttggacctggacatcaagtactacgacttggggattctacaccgtgatgcaactgatgacaaggtcacggtggaggccgcagaggctactctcaagtacaatgtggctattaagtgtgctaccattaccccagatgaaactcgggttaaggagttcaacctgaagcacatgtggaagagcccaaatggaacgattaggaacattataaatggtactgttttcagagagccaattatatgcaaaaatgttccaagacttgttccaggatggactaagcccatttgcattggaaggcatgctttcggtgatcagtaccgggctactgatgctgttctgaaggggcctgggaagctcaagctagtttttgagggaaaggaagagcagatcgatctggaggtattcaacttcactggtgctggaggagttgccttgtctatgtacaacacggatgagtcaattcgagcttttgccgcggcttctatgacaactgcttatgagaagaaatggccgctctaccttagcaccaaaaacacaatcctgaagaaatacgatggcaggtttaaggacattttccaggaggtctacgaagcagactggaaatcaaaatttgaggctgctggaatatggtacgaacatcgtctgatcgatgacatggttgcatatgcgcttaagagtgaaggaggctatgtgtgggcttgcaagaactatgatggagatgtgcagagtgatttcttggctcaaggttttggctcgttgggtttgatgacatcagtgttggtgtgccctgatgggaaaaccatcgaagctgaagctgctcatggcacagttacccgccacttccgtgttcaccagaaaggaggtgaaaccagtacgaacagcatcgcttcaatctttgcttggacgagaggacttgcacacagggcaaagctcgatgacaatgctaggctacttgactttgcactcaaactcgaggctgcctgtgttggaactgtggagtctgggaagatgacaaaagatcttgcacttcttgttcacggatcttccaacgtcacgagaagccattacttgaacactgaagagttcattgatgccgttgctgctgagctccgatcaaaactggcatccaattgagcttacaggaaacttttggcaaatttagtgcttcattcatcacggaccgctcctaagtcatttctgctacatcagcattgttattcacgcttcgcaatggagtgaatgtgccttactgccatttcgatgtaaagctaattcaagatgctactagtgttgtgcgcgcgctctaaataagggacatatatagaacgattggccagtgctgtgatttggttaccagcaataagctgctccatcgtatttgtggagatttgtctttgttttctcctttgaattgcatggctatagtcgttcaccaatcatcagtttttctactgtgtttaggaggcagtaaagggtccttaatcaaccctaattaaacaggggaaaaaatgatcaatgtgttgagt

SEQ ID NO: 1727 - DNA, 1595 bp, Thellungiella halophila
aatcggccatcacgctactccagtcaccagcaaatcatctccctccttcgacgatctgcgtctctcgccgggaaacttctctcgttcgtagatcgccggcgatttaaaaatctagatcgtctctcgtaaaacctagcgagaagccatggcgtttgagaagatcaaggtggcaaatcccatcgtcgagatggatggtgatgaaatgaccagagttatttggaagtccatcaaggataagctcattacccctttcgtggagttggatatcaagtacttcgaccttggtcttcctcaccgtgatgctacggatgacaaagttaccgtcgaaagtgctgtagccactaaaaagtataatgtggcgatcaagtgtgccaccatcactccagatgaaggccgtgtcacagaatttggtttgaagcagatgtggagaagtccaaatggtaccatcaggaatattctgaacggaactgtatttagagaaccaattatctgcaaaaatgttcccaagcttgtcccaggctggactaagcccatctgcattggaagacatgcttttggagatcagtaccgtgccactgatgctgtaatcaagggaccaggaaaactgactatggtttttgagggaaaagatgggaaaactgaaactgaagtctttacatttaccggtgaaggtggtgttgctatggccatgtacaatactgatgagtccatccgtgcttttgctgaggcatcgatgaacactgcttacgagaaaaagtggccactttatcttagcacaaagaacaccattcttaagaaatacgatggcagattcaaagacatcttccaagaagtgtatgaagctagctggaagtcaaagtatgaagctgctggtatatggtacgagcaccgtctcatcgacgatatggtggcttacgctcttaagagcgaaggaggctatgtgtgggcatgcaaaaactatgatggtgatgtccaaagcgatttcttggcacaagggttcggatcacttgggttgatgacatcagttttggtttgtccggatgggaagacgattgaagctgaagcagctcatggaacggtgacacgtcactacagggttcaccagaaaggtggtgagaccagcacaacagcatagcttctattttcgcttggactcgtggtcttgcacacagggctaagttagatgacaactcaaaactgttggaattcaccgagaagctcgaagctgcttgtgtcggtacagtggagtctgggaaaatgactaaagatcttgcactcatcattcacggctcaaagctctcgagggacacttacctgaacacggaagagttcatcgatgcagttgcgaacgagctcaaagcaagactcggcatcaaagcttaagagaactaaagactcagttactcagtcattaatttctatctggtgggtttgtgagagtggttggtgggattgggagaaataaaaaagagaaacttttggtttaaggggaatattgagaacgatttgtttcctctctttataatattttctaaacattgcgacattttttttctttcttatttataatttatgcagatcacgaattttatttg

SEQ ID NO: 1728 - DNA, 1297 bp, Nicotiana tabacum
  misc_feature (17)..(17): n is a, c, g, or t
ggccgacgaagctttcnttaccaaattccattacactttatacccttttatttccatacttatcatatatcaccagaatttccagttcttaatctcaattctttacaagaaatggcttttcaaaagattaaagtggttaatcccatagttgaaatggacggagatgaaatgacccgtgtcatttggaaattaattaaggataagctcatctttccctttgtggagttgggtataaaatacttcgatcttggtcttcctcaccgggatgccacagatgataaggttacagttgaaagtgctgaggctactttgaagtataatgtggcaattaagtgtgcgaccatcactccagacgagggccgaatgaaggagtttaacttgaagcatatgtggaagagcccaaacggaacaattaggaacattctgaatggtaccgtgttcagggaaccaatcctttgcaaaaacgttccccgacttgtcccaggttggtcaaaaccaatatgcattggcagacatgcttttggtgatcaatatcgagctactgatacagtaattcaaggacctggaaaactaaaactagtatttgtaccagaagggaaggatgaaaagaccgagttcgaggtttacaacttcactggtgctggtggagtagctctgtccatgtacaacacagatgagtctattagctcttttgctgaagcttctatgaacatggcataccaaaagaaatggccgctctatcttagcacaaagaataccatccttaagaaatatgatggaagattcaaggacatattccaggaagtttatgagtcaaattggaaattaaagtttgaggaagctggaatctggtatgaacatcgcctcatcgatgatatggttgcttatgctttaaaaagtgatggtggttatgtatgggcgtgcaaaaactatgatggggatgtacagagtgatttcttagcacaaggattcggatcccttggattgatgacatcgattctgatatgtccagatggaaagaccatagagtcagaagcagcccatggaactgtgacacgacactacagggttcatcaaaaaggaggtgaaaccagcacgaacagcattgcctcgatttttgcttggactcgtggacttgcacatagggcaaagttggacaacaatgctgcactcttggatttcagcaagaaactagaagcagcttgcatcggtgcagtggagaacgggaaaatgaccaaagatctagcacttatcgtccatggatccaaagttgctagacatcaatatgtgaacactg

SEQ ID NO: 1729 - DNA, 1617 bp, Nicotiana tabacum
ggcatcatctttcaccaacttcccctcttcactgtttctctcttcgccggagatttctctgttctatcttcatctgcaaacatggctttcgacaaaatcaaggttgaaaaccctatcgttgagatggacggagatgaaatgactcgtgttatttggaaatcaatcaaggataagctcatctgtccctttctggagttggatataaaatactttgaccttggccttcctcaccgtgatgccacagatgataaggttacagttgaaagtgcggaagccactcagaaatacaatgtagctattaagtgtgcaaccattactccagatgaggcccgtgtaaaagagtttaacttgaaatccatgtggaggagccctaatgggacaattagaaacatcctaaatggaacggtcttcagagaaccaattatgtgcaaaaatattccccgacttgtcccaggttggactaaaccaatatgcatcggtagacatgcttttggcgatcaataccgggctactgatacagttattcaaggagctggaaaactcaaattggtgtttgtgccagaaggaacagacgagaagactgaatttgaagtttacaactttactggtgctggtggagtagctttatccatgtacaatacagatgagtccatccgctcatttgctgaggcttcaatgaacatggcatatcaaaagaaatggcctctctatcttagtacaaagaatactattcttaagaaatatgatgggaggtttaaggacatcttccaagaagtttatgaagcaaattggaagtccaagtatgaggaagcaggaatttggtatgaacaccgtcttatcgacgatatggtcgcttatgctttaaagagtgaaggtggttatgtatgggcctgcaagaactatgatggggatgtacagagtgatttcttagcacaaggttttggatcccttgggttgatgacatctgtcctggtgtgtcctgatggcaagaccattgaggctgaagcagcccatggaactgtcacccgccactacagggttcaccagaaaggaggtgaaaccagcacaaacagtattgcgtcaatctttgcctggactcgtggacttgcacacagggcaacgttagacaacaacgaaaggctcttggattttactgagaaactagaggcagcatgcattggtgcagttgaatctggaaagatgaccaaagatcttgcacttatcatccatggatccaagctctcgagagatcattatctcaacactgaagagttcattgacgccgtggccgatgagctcaaagcaagacttctgaaagcaaaggcctaaatgtctgggcagacaagaggacagtcttttttctggggcagttgagggatattgaagtgaaataaaaggattagggcctgatggtatactaaatctcaagaggttttattttataggttggggttactctccaggcattaatgtttgaaccatttaaatctgaatttcctttttgctgaaactgctgcaagttatttcctgatttgcaattgtacacttgacttgttgttttatcagtttgctaaaagaagcccctcttcattaacttctgctttcttttggtggttc

SEQ ID NO: 1730 - DNA, 1624 bp, Solanum lycopersicum
attttttccccatttcgttacaatttaagcttctcccgcaggcgaaactttctttatcaaacaccattactctttatagtaccagaatttccagttcttgatctcaatttttcactgaaaatggctttccaaaagatcaaagtggctaaccccatagttgaaatggacggagatgaaatgacccgtgtcatttggaaattaattaaggataagctcatcttgccttttctggagttggatataaaatacttcgatcttggacttcctcatcgtgatgccacagatgataaggttacaattgaaagcgctgaggctactttgaagtataatgtagctattaagtgtgcaaccattactccagatgaggctcgtatgaacgagtttaacttgaagcatatgtggaagagcccaaatgggacaattaggaacattttgaatggtacggtgttcagggaaccaatcctctgcaaaaatatcccgcgacttgttccaagttggtcaaaaccgatatgcattggcagacatgcttttggtgatcaataccgagctactgatacagtgattcaaggagctggaaaactcaaattagtatttgtaccagaagggacagatgaaaagaccgagtttgaggtgtacaacttcactggtgctggtggagtagctctatccatgtacaacactgatgagtctatttgctcttttgctgaagcttctatgaacatggcataccaaaagaaatggccactctatcttagcacaaaaaataccatccttaagaaatacgacggaagattcaaggacatattccaggaagtttacgagtcaaaatggaagtcaaagtttgaggaagctgggatctggtacgaacatcgcctcattgatgatatggttgcttatgctttaaaaagtgacggtggttatgtatgggcatgtaaaaactatgatggagatgtacagagtgatttcttagcacaaggatttggatcgcttggattgatgacatcgatcctgatatgtccggatggaaagaccgtggaagcagaagcagcccatggaactgttacacgccactacagggttcatcagaaaggaggtgaaaccagcacaaatagcattgcctcgatttttgcttggactcgtggacttgcacatagggcaaagttggacaacaatactgcactcttggatttcaccaagaaactagaagcagcttgcattggtgcagtggagaacgggaaaatgacaaaagatctagcacttattatccacggatccaaggtcgctagacgtcaatatgtgaacactggagagttcatcgatgctgtggctgatgagctgaaagctagacttctaaaagcaaagatataagtgataggtttccgcttagaggagaatgacattttgccagaactttgaggatcgattcatatagacgatctgaacttgtttgggattaaggtgtcagttgttgtattatggctctagtgcatcattattcactaatccacacttaaccctggattagtgtgtgttcttgttcccctcattgatccatgtggaaaataaactttgaattttcagatgattttttatgcaaaataaaattagtgtataatgtttcata

SEQ ID NO: 1731 - DNA, 1641 bp, Solanum lycopersicum
acttcttctgcactctgcattttctttctaccaacttttctctattcggcggagatttcttgttgatttttttctctcaatctgcgaaaatggcgtttcagaaaatcattgttcaaaaccccatcgttgagatggatggagatgaaatgactcgagttatttggaaatctatcaaggataagctcatccttccctttctggaattggacatcaaatactttgaccttggtcttccccaccgtgatgccacagatgataaggttacaattgaaagtgcggaagccactcagaagtacaacgtagctattaagtgtgcaaccatcaccccagatgaggcccgtgtaaaggagtttaacttgaaatccatgtggaggagccctaatgggacaatcagaaacatcctaaatggaactgtctttagagaaccaattatgtgcaaaaatatccccagacttgtcccaggttggaccaaaccaatttgcattggtagacatgcttttggagatcaataccgagctactgatactgttattaaaggagctggaaaactcaaattggtgtttgtgccagaaggatcagacgagaagacagaatttgaagtttacaactttactggtgctggtggagtagctttatccatgtacaacacagacgagtctgttcgcgcatttgctgaggcttcaatgaacatggcattccaaaagaaatggccgctctatcttagtacaaagaataccattcttaagaaatatgatgggaggttcaaggacatcttccaagaagtttatgaagcaaattggaagtccaagtatgaggaagctggaatctggtacgaacaccgtcttatcgacgatatggttgcttatgctttaaagagtgaaggtggttatgtatgggcctgcaagaactacgatggggatgtacagagtgatttcttagcacaaggttttggatcccttgggttgatgacctctgtcctggtgtgtcctgatggcaagaccattgaggctgaagcagcccatggaactgttacccgccactacagggttcaccagaaaggaggtgaaaccagcacaaacagcattgcctccatctttgcctggactcgtggccttgcacacagggcaacattggacaacaacgaaaggctcttggattttactgagaaactagaggcagcatgcattggtgcagtggaatctggaaagatgacgaaagatcttgcactcatcatccatggatccaagctttcacgagagcattatctgaacacggaagagttcattgacgctgtagctgatgagctcaaagcaaaacttctgaaagcaaaggcctaaatgtatgagtgaggacaagtcagtttgaggctattgaattgaagagaaataaaaggagttaaggccttgtttggtatactaaatttcaagaggtttttatcctttttaggttgaggattattctccagacactacattttgaaccatttgaatctgaatttctattgctgatgttgctgcaagttatttgccaatttatagttttacacatagtttgttgttgccttttaatatcaatttgcttgagaaaaaaaacatctttattaattgttgcaaagttttgaagtactgtagttagagggca

SEQ ID NO: 1732 - DNA, 1506 bp, Triphysaria pusilla
  misc_feature (585)..(585): n is a, c, g, or t
  misc_feature (591)..(591): n is a, c, g, or t
aagagaaaaaaggaaacaaaaaactaaatggcgttcgaaaagatcaaggtggccaaccccatcgttgagatggacggagatgagatgacaagggtcatctggacatttatcaaagacaagttgattttccctttcgttgagttggatatcaagtacttcgatcttggactccctcatcgtgatgccactgatgataaagtaactgttgagagtgctgaagctactctaaagtataatgtggcaattaagtgtgcaacgatcactccagatgaagctcgtatggaggaatttaaattgaagagtatgtggaggagcccgaatggtacaattaggaatatattgaatggcacggttttcagagaaccgattctctgcaaaaacgttcctcgtcttgtccctggatggactaagccaatttgtattggaagacatgcttttggagaccaataccgagcaaccgatacggttattaaaggacctggaaagctcaaattggtgtttgtgccagaagggaaagatgaaaagacagaatttgaggttttcaatttcacaggtgctggtggggttgctttgtccatgtacaanactgangagtccatccgttctttcgcagatgcttcaatgaacaccgcatacctgaaaaagtggccattgtatcttagtacaaagaatacaattctcaagaagtacgatggcagattcaaggacatattccaagaagtttatgaatcaagttggaaatcgaagtttgaggaagcaggaatatggtatgagcatcgtctcattgatgatatggttgcgtatgctttgaagagcgaaggaggttatgtatgggcttgcaagaattatgatggagatgtgcagagtgatttcttagcacaagggtttggatctcttgggttgatgacctctgtcttggtatgccctgatgggaagacaattgaggctgaagcagcccatggaactgttacgcgtcactatcgtgttcatcaaaaaggaggtgaaaccagtacaaacagcattgcatccatctttgcttggactcgtggtcttgcacacagggccaagttggatgataatgcaaaactgttggagttcactgagaaattagaagcagcttgtattggcgttgtggaatctgggaagatgactaaggatcttgccctcatcatctacggaaccaagttaaccagagacaattatctgaacaccgaagagttcattgatgcagtagctgatgatctcaaagctagacttacccactgagtgtatggatacctttcggagacgttttctggcattgttttgatttcactgagatgctaccaatatatggtcattgcgaagaagttattattgtatgtgggaacttttaccttcatttttaaataagttaaccatccattttacatgctagttgcatttggttttggcaaacatataaacttgttacgacacttgcaagtcaccaatggaggaaacaatgatcttcgtacctgcccgggc

SEQ ID NO: 1733 - DNA, 2492 bp, Triticum aestivum
  misc_feature (752)..(752): n is a, c, g, or t
  misc_feature (902)..(902): n is a, c, g, or t
  misc_feature (953)..(953): n is a, c, g, or t
  misc_feature (1361)..(1361): n is a, c, g, or t
  misc_feature (1370)..(1370): n is a, c, g, or t
aactgcctcgttctctccgcgctccggtctccccagtccacgccgcgcaggctggaagagctcgaattccctcccgcctcgcctcgcctcgtcccggagaaggctagctgccccgcgagccgagcgcggcgcccatggcgttcgacaagatccaggtcgccaaccccatcgtcgagatggacggtgacgagatgacacgaattatatggaaatggatcaaagataagcttatatttcctttcctggacttggatataaaatactttgacttaggtctacctaaccgtgatgctactggggataaagtaacgatagaaagtgcagaagctaccctaaagtataacgtggccatcaaatgcgcaactgtcaccccagatgaaggacgcgtaaaagagtttaatttaaaagctatgtggaggagtccaaatgggacaataaggaacatcttaaatggaactgttttccgagaaccaatcatctgcaagaatgttcctcggcttgtgcctggatggacaaaacccatatgcattggcagacatgcttttggtgatcaataccgagcaacagatacaatcattagagggccagggaagctcaagttgatatttgatggcatagaggaacaaatagagttggatgtgttcaactttagtggtgctggtggagtagcattgtctatgtataacactgatgagtcaattcgggcatttgctgaagcttcgatgaatgtggcttaccagaaaagatggccnctttatcttagtaccaagaacacaatcctgaaaaaatatgacggaaggtttaaagacatattccaagaaaactatgaaacaaattggagaggcaggtttgaggatgcaggaatatggtatgaacatagactgatcgatgatatggtggcntatgccctaaagagtgaaggtggctatgtttgggcttgcaagaattatganggagatgtgcagagcgatctagttgctcaaggttttggatcgttaggtctcatgacatcggttctggtgtgccctgacggtagaacagttgaagctgaagctgcacacggtacagtcacacgacattacagagtccaccaaaaaggaggcgaaactagcacaaacagcattgcgtcaatctttgcgtggtctactggattagcacatagggcaaagctcgatgacaacaaaagactgttggatttcacacaaaaacttgaagctgcttgtgtgggaacagtggaatctggaaagatgacaaaggatctagctcttctcatacacggaccaactgttagccgtgataagtatctgaacaccatggagttcattgatgcggttgctgaggagttgaggacaagattgtcngcaaaatcnaagttatgaaggagtgaataggacaagggacttgttaggatcctataatacaaggtttgcgtttgtgctacgaatagggcaacgtgtcttccctacagtgctcaaatagagcctctggtgacagtctgaatgcacctccgaacaatgaaggaagatgctgtctagctcgaaaataagtaggctcttttttatcggattcttggtgatgatcgagtcatttcatgcagctcttcagatagcgatgtccaaatccaagttgggcttcttacacctacacacccgaagtggtgtttgtaccagacataataagccactttattcaaacattgtaatgccaccacatgaaatcaaaagccaatttgaaatctgaagctggtcatccaacgatatgagcgacatgtttctttggtgcttcagtttcctctcatcacaggacaacctgaagccgatgcagcagcagcagtagcaggcgcgctcaagaagcttgcgaggaagttgccgcgctcgtagaagtactccgccttctccaccttcatctcctcatcaacatggaagacgcagaccccaaagaactcgacgcgctggccgtgaggagggtgccccttgaacggcccctccatgtaaccccagtgccggaacttgaaggcgaccctcggcgggccgctgtacacgtccagcacctcgatggcgaagcccctggggaacgccgtgaggaacgtcgacatgccggagtcgaccgtctccttgtccgggtcgtagatgcggtgctccggcggcagcttggtcgccaggaacgcgttgtagccgccgatggcagtccactccttccgcgttagaggcttcatcccgttggtgctcgcggtgaatccctgggagtggacgctcttctggtcgtcggggcgcaccttgtggatcatctccatctcccaggtcttgagcaggcgctgcaccttctcctcaagagacccatccggccattccttggtcctctcttcctcgaagagcttgttcacgatgtcgtagttgggaggggctccatgcctccacacggtgttcttctcgccctcgccgtgcatgaacgaccggtacttgtcacctcctgtttcagtagacgccatggct

SEQ ID NO: 1734 - DNA, 1849 bp, Oryza sativa; identical to SEQ ID NO: 163

SEQ ID NO: 1735 - DNA, 1061 bp, Hordeum vulgare
ctcaggtgactggattcggcccttcccccccgaagccaccgctgccgagccttcaacctcctcccgccgccgtcccgtctaccgggtcccgccgccgagcccacggacgcctccccgcacaggaagccgccccccaagccccggaccgacggcaaggagtgtcgccacaaccgctgtcaactacggcattacacatctcgcggttcacaaatctcaaaaggaaaccgcggggggcatggccatggccgtggcggaggcacgtctccggcaggagaaggtgaagaagtttgaagatttcgtggaccgacgcctcaagcctgaccttgtgaacgccatagcccagcgcgataacttgttccagcagcagaagactttcttggatttgaagaagaacatcgaaaatttggaaaagaatggtgtaacgagcatgcgctccatggtcaatcttggctcagaggtgtacatgcaagcagaagtgccggacacgaggcacatctttgtggatattggtctaggttttcatgtggagtttacttggcaagaggctttgcagtttatatctgtaagagaagcaaggttggccagacaaatagacgagtacacacacctcatagcgagcataaaggcacagatcaagatggtatgtgaaggtatccgtgaactcctgcaattaccagcggagtgagctgccgggatcaaactagcggcagagagacgcttacacaccaaacttgcggcagagagatagagatgcttggtagaggggtatgatgtatcttgccatggaattttttaagattcttacacgaagggtatgacaacgatgcagctctctcaagtagtcccactgctgactaggcggcattcagcattctgtaaactaaatataggtaaaaagaagtggcaaatgagaatgctgtgatcattgaactcgtgtttaaattctgggacgtttgttgaaaatcacaagtgtcttgacttgatattagcttgtatgtgcagactgaattttcagatgattggcaggaaatgcaatgccttgatgataacgtttcttgctg

SEQ ID NO: 1736 - DNA, 949 bp, Brachypodium distachyon
taggtcaggaactcgtcccagctcgtctcgtcaggcgtcagcagacgctgggctgggcgtcaggaactcgccgtccgcctctgccccgaccggcgaccgtctctttaccccgacaggcgaccgtctgcctctgcccccaaatactgaaatccccaagcggaatcggctgcacacgttgtctggcacggcaagataatatctcacagttcacaaatcccaaaggaaaccggcaggtgctatggctatggctgcagtggaggcgcggctccggcaggagaaggtgaagaagttcgaggattttgtcgaccgccgactcaagcccgacctcttaaatgccattgcccagcgtgataccttgttccatcagcagaagactttcttggatttgaagatgaacattgagaatttggaaaagaatggtgtaaccagcatgcgctccatggtcaatcttggatcagaggtgtacatgcaggcagaagtgccagatacgaggcacatttttgtggatattggtctaggttttcatgtggaatttacttggcaagaagcattgcagtttatatctgtgagagaggcaaggttggccagacaaatagatgagtacacacacctcatcgcgagcataaaagcacagatcaagttggtatgtgaaggtatccgtgaactcctccagctaccacctgagtgagagccaaagagttacgcaccaagccggcagtgccctagctcttacataccagtagttttttttttcctgttcttgcgatgattaatcagacaattggcaaatgagaacagttcgatagttggactcgttcgatgtggtagtcctgtttaaaatttaaatgaggagaaccttgtagcaaattaacaagacagaaatgattacattatagtccagtccttgtttggtgatatgcaattatgaaacacgggattggtcactgtt

SEQ ID NO: 1737 - DNA, 1210 bp, Zea mays
caggcagcccgcagccggtcagtccttccttctcctgttcgcgtccacgatcctgccgccgccgctcgcacctccacgatcctgcccagcgccgtgcgcctccacccccgccccgtccgccgcccgcccggctggccggcggcgccaccccgggacccgcgcgcgtggagccccggcctctaccagccgcacgtcgcaaccggcgaggacgcgcgcgcctgcagctcctgcccggtcccggctggccggccgccggcactccggctgcccctcagcggctcagcccctgagcttgtctgcttgactgcttcagtgcgggtgcagcacagcggcagtgccccctgtcagtgccagccgccttagctactgcttactacgttgcatttttttccctgttttgtggactgtggtaattgactgtgtatcgagcaggcataccctgttaaaaatcctggttccactactagtcaggccatggctgcagcagaggcatgggtgcggcaggagaaagttaggaagtttgaggagttcgtggaccagcggttgaaacccgacctcaccaatgccatcgcacagcgtaacaaggtgtttgagcagcagaagaccttcttggatttgaagaggaacattgaaaatttggagaggaatggtgttaccagcatgcggtccatggtcaatcttggctcagaggtgtacatgcaagcagaagtaccagatacaaggcatatttttgtggatatcggtctaggttttcatgtggaatttacttggcaagaagctttacagttcatatctgtaagagaggcaaggttgactaggcaaatagacgaatacacgcatctcatcgcaagcataaaagcacagatcaagttggtatgtgaaggtatccgcgaagtgctgcagctgcctgcggagaaagagttatcgcccaggaatacgtggtagaatttggttctcaatggagcagggggtggtgttctgtaaacgtggttccgtttcaactcttgcagttgaaattattgtggtgccgacagtattttagagcagagaatgaggttccccttcgtacaacaatctcttcgacgacaccacgtacaactcatactgatttctatgtattcattacgttggcatatggccttgccgatccaatgatttcacgatcgattatatcatttaccgtcatcctgtaacttcctgttttgttttt

SEQ ID NO: 1738 - DNA, 1042 bp, Sorghum bicolor
ctcgtccccaactctctcctctcagtttcaaaaaaaaaactctctcctctcctaaccctaacagaggcggcggcggcggcgtgccggtgcggcgctcggcgcacccgctcccggcacctaggcgttcggcgcacgccacgcacccgcacccaggcgctcggcgcacggctcacctgcacggccacccccaggcgctcggcgctcggcgcaaggcggcacgcgccacgcggcacccaggcgctcggcggcttcggcgcacccgcacggccgcacccaggcgctcggcggcttcggcgcacccgcacccgcacccaggcgcgacgcgtacgactatcgtgtattgaacaggcacaccctgctaaaatcctggttccactaccactagccaggccatggctgcggcagaggcgtgggcacgacaggagaaagtgaggaagttcgaggagttcgtggaccagcggttgaaacctgaccttgctaatgccatcgcacagcgcgacaaggtgtttgagcagcagaagaccttcttggatttgaagaggaacattgaaaatttggagaggaatggtgttaccagcatgcggtccatggtcaacctaggctcggaggtgtacatgcaagcagaagtaccagatacaagacatatttttgtggacattggtctaggttttcatgtggaatttacttggcaagaagctttacagttcatatctgtaagagaggcaaggttgactaggcaaatagatgaatacacgcatctcatcgcaagcataaaagcacagatcaagttggtatgtgaaggtatccgcgaagtgctgcagctgccagcggagaaagagttatcgcctaggaatacgtggtagaattggttctcactgtcactggggcagggggttggtgtgccgcttccgtttttacatgacaactacctggcttcatctctgatgaactcgtgcagttgaaactattgaggtgtcgagagtaacaatctctttgacgatacgacgtactacgacatttctaaagtcttcattgcgttgcc

SEQ ID NO: 1739 - DNA, 706 bp, Saccharum officinarum
  misc_feature (60)..(60): n is a, c, g, or t
  misc_feature (66)..(66): n is a, c, g, or t
  misc_feature (85)..(86): n is a, c, g, or t
  misc_feature (620)..(620): n is a, c, g, or t
  misc_feature (637)..(637): n is a, c, g, or t
  misc_feature (661)..(661): n is a, c, g, or t
  misc_feature (670)..(670): n is a, c, g, or t
  misc_feature (690)..(690): n is a, c, g, or t
  misc_feature (695)..(695): n is a, c, g, or t
tagatcgtgtattgaattataccgaacaggcataccttcttaaaatcctggttccactantactanccaggccatggctgcagcnnaggcgtgggctcggcagaagaaagtgaggaagttcgaggagttcgtggaccagcggttgaaacccgaccttgccaatgccatcgcacagcgcgacaaggtgtttgagcagcagaagaccttcttggatttgaagaggaacattgaaaatttggagaggaatggtgttaccagcatgcggtccatggtcaatcttggctcggaggtgtacatgcaagcagaagtaccggacacaaggcatatttttgtggatattggtctaggttttcatgtggaatttacttggcaagaagctttacagttcatatctgtaagagaggcaaggttgactaggcaaatagatgaatacacgcatctcatcgcaagcataaaagcacaagtcaagttggtatgtgaaggtatccgcgaagtgctgcagctgccagcggagaaagagttatcgcctaggaatacgtggtagaatccggttctcactggagcagggggttggtgtgctgccgtcggcaaacatggttccatttttacatgacaacaanctggcttcatctctganaaactcctgcagttgaaattattnaggtgtcgngagtattttaaaccagacantgagnctgcccttcgt

SEQ ID NO: 1740 - DNA, 1075 bp, Panicum virgatum
gacagatacccgccacagcacagcgaacacagccctagccgctgccgcctgccggcgctgccaaccctagctcatgttcctgcggcggcggcggcactccccggaggtgcaagaacctgcgccaccagccggcgcccttccctttttcaagtatttcttcccccaacgcccctagccttttctgtctctgtcgccggcgtcctttcgccgccgccgccatcgccgtcgttcttctcttctatctctctctgttattcagtctccagctatcgagcgacttcaggctcagtccggcaaacaccttcaagctcaatccgacgcccttcaagatctggcttgcaggaatccaaagggctcctttgatcagctctggtttgatgttggtggtttctgcttatcggatcactccaagtttcaattccagggtccgccactggtttcgggggaaccctaccgggggccatggctgcggcggagacacgggcgcgacaggagaaagtgaggaagttcgaggagttcgtggaccagcgtctgaagcccgacctcgccaacgctattaagcagcgcaacaaggtgtttgagcagcagaagaccttcttggatttgaagaggaacattgaaaatttggagaggaatggcgtcactagcattcggtccatggtcaatcttggctcggaggtgtacatgcaagcagaagtacaggacacaaggcacattttcgtggatattggtctaggttttcatgtggaatttacttggcaagaagcattacagtttatatctgtaagagaggcaaggttggctaggcaaatagatgaatacacgcatctcattgcaagcataaaatcacagatcaagctggtatgtgaaggtatccgtgaactgctgcagctaccaccggagacagagttatcacctaggaatacatggtagaatttggttctcacggcaaagggttggtgacatcgagcttgtaaaatgtggtgcagttgtgcaagatggttccatttatgacagcaacatggcttaaaaatctgatgaccacctgcagttgaaattatccaaaccttggagt

SEQ ID NO: 1741 - DNA, 597 bp, Panicum virgatum
ggaaccctactggggcccatggccgtggccgtggccgtggcggaggcacgggcgcggcaggagaaagtgaggaagttcgaggagttcgtggaccagcatttgaagcccgaccttgccaacgccatcaagcagcgcgataaggtgtttgagcagcagaagacctttttggatttgaagaggaacatcgaaaatttggagatgaatggtgtcaccagcatgcggtccatggtcaatcttggctcggaggtgtacatgcaggcagaagtaccagatacaaggcacattttcgtggatattggtctaggttttcatgtggaatttacttggcaagaagctttacagtttatatctgtaagagaggcaaggttggctaggcaaatagatgaatacacgcatctcattgcaagcataaaagcacagatcaagctggtatgtgaaggtatccgtgagctgctgcagctaccaccggagacagagttatcacctaggaatacatggtataataatagaatttgatagaataatcgaacttgtaaaatgtggtgcagttctgcaagatggttccatttttatatggcagcaacttggcttaaaatc

SEQ ID NO: 1742 - DNA, 641 bp, Panicum virgatum
ggagacacggacgcgacaggagaaagtgaggaagttcgaggagttcgtggaccgtcgtctgaagcctgacctcgccaatgctattaagcagcgcgacaaggtgtttgagcagcagaagaccttcttggatttgaagaggaacattgaaaatctggagaggaatggcgtcaccagcatccggtccatggtcaatcttggctcggaggtgtacatgcaagcggaagtaccggatacaaggcacattttcgtggatattggtctaggttttcatgtggaatttacttggcaagaagcattacagtttatatccgtaagagaggcaaggttggctaggcaaatagatgaatacacgcatctcattgcaagcataaaagcacagatcaagctggtatgtgaaggtatccgtgaactgctgcagctaccaccggagacagagttatcacctaggaatacatggtagaatttggttctcacggcaaagggttggtgacatcgagcttgtaaaatgtggtgctgttctgccagatggttccatttatgacagcaacttggcttaaaaatctgatgaccacctgctgttgaaattattcaaaccttggagtaatctgaaaccagatcatgaggttgccgatagtacaact

SEQ ID NO: 1743 - DNA, 1012 bp, Triticum aestivum
  misc_feature (31)..(31): n is a, c, g, or t
  misc_feature (34)..(34): n is a, c, g, or t
  misc_feature (393)..(393): n is a, c, g, or t
aagccaccgccgacaagccttcaacctactnccntccgccgtcccgtctaccgcgtcctcccgccgagcccacggacgcctccccgcaccggaagccgcccccaagcccccgaccgacggcaagaagtgttgccgcagccgctgtcctgtacgacattatatatcccgtggttcacgaacctcaaaggaaaccgtcggggacatggccatgaccgtggcggaggcgcgtctccggcaggacaaggtgaagaagttcgaagatttcgttgaccggcggctcaagcctgaccttgtgaacgccatcgcccagcgtgataacttgttccagcagcagaagactttcttggatctgaagaagaacatcgaaaacttgggaaaagaatggtgtaacgngcatggatccatggtcaatcttggctcagaggtgtacatgcaggcagaagtgccggacacgaggcacatttttgtggatatcggtctaggttttcatgtggaatttacttggcaagaggctctgcagtttatatctgtacgagaagcaaggttggccagacagatagatgagtacacacacctcattgcgagcataaaagcacagatcaagatggtgtgtgaaggtatccgtgaactcctgcagttagcagcggagtgagcattagggtcccaatgccaagaatgtatgccaagaacgcagctctcccaaatcccaatgtttttgttttagggtcccaaatcccaatgttgatcaggaggcattgtgtaagtataggtgaaagaagtggcaaaagagaatactttgcttgatctagcatcctgcccgggcgtgcctccttttcgtaagtctgggagataaatcgtggcgtggcgtgcatgagtgatgtcaactctctgttcttggacggatgagtgattcagtggagtggagctgggtcgttccttccctttgcttgcaaagtacagtagtattcaagaaagcagacgtcatcaataagaagagtttcacacccaaaaa

SEQ ID NO: 1744 - DNA, 1998 bp, Hordeum vulgare
aaccagtctctcacgaattgtcgccttccacttgtctcacggtctccgtccccatctcccccctccgccgcatccgccgcgccgccggcgacgaccccgtcgacagatcttcacaggcaccctccaccatgtaccgagccgcctccggcctcggcgccctcaagcggcatggggcggatacccaaatgttggatattgcggttaggtctgctagcacaagtgttgcacagaggtcatcaggcggcttcttgggctggctgacaggtgcacgttcaaatgcactaccccctccagattttgcactcccaggagtcactattcctcctccgctagctgatcatgtggagcctggcaagacaaaagtcacaacactacctaatggtgtaaaaattgcctctgaaacatctccaggatcatcatgttctgttggagtttatgttaactgtgggtctgtatatgaaacacctgagacactgggtgccactcagttattaaagaagctggcctttacaaccactagaaacaggagccagttgcgtgttgttcgtgaaattggtgcaataggtggcagtgcgaaagtgtcagccaaccgtgagctcatgagctacagttatggagcccttaagacttacatgcctgaaatggtggaagtgctagttgattgtgtgcggaatccagctttacttgattgggaagtcaaggaagagataatgaaactaaaggcagagcttgcagaagcttcaagtaatccggaagctttccttttggatgctcttcattccagtggctattctggtgccttggcaaacccattgattgcctcagagtcttcaattagcagattaaatacagatgttctggaagaatttcttgccttaaactacacttccccgcgaattgttctagctgcatctggtgtggaccacgatgaacttgtatccattgctgaaccactcctgtctgatattcgtaccgcaactggaacagtaaagccaaaatctgtctatgttggtggagaatatagacgtgcagcagattcatcgaacacagatcttgctttggcatttgagctcccaggtggatggctgaaagaaaaagaatttgctactgcatctgttcttcaggcacttctgggtggtggtggtgtgtttacctggggaagacctggaaaaggcttgcattcacgcctgaaccccctcgtaaatgaatttgacgaaatcaagtcgatctccgctttcaaaaatgttcacagtaacaccggcatttttggaattcatgcatcgactgatgcagcatttgttcctaaagttattgacttggcagccagagaactcacttccctcgcgacccctggtcaagttgaccaaacccaactggaccgtgctaaagcatctgcaaaatcagttatcttgaggaacctggaatcaaaggcatcaacaactgaagacatggggcgccaagcattggcatttggtgaaaggaaacctgtggagcagcttctaaaggctgttgatgctataactctggcagatgtatcaactgttgctgcgaagatcatctcatcaccattgacaatggcatctcatggaaacgttctcagcgtaccagcctatgagacagtgcgtggcaagttcagctcgaaatgaggaggcttctgaacaagttaactgttcatattttttcttcaagatcatctgtggtcacatttttcacaagaaaaataagatgcatacaattttggtcattaactcctctacactgggacaactttgggatcttatttttttgcctcgtgtatccacctgagtttggtggtgtgatgttgttctcttgagatatgttactgtaaattcagtgaaatcatgcatgggtggccctctttcggtggcagtccggaagggtgtacaaaatgttcctccactttttttggttaaagtcgttgaaactagtgctggggcaaggaaatgaataaagattcaatatgacggtgaaattttc

SEQ ID NO: 1745 - DNA, 1958 bp, Brachypodium distachyon
tctccatcccccatctccgcctccgccgcatcctccgcgccgccggcgacgactccgtcgagcgaatccacctcaggcgccgggcaccatgtaccgagccgcctccggcctcggcgctctcaagcggcatggggcggatgctcaaatgttgaatcttgcgattaggtctgctagcacaagtgttgcacagaggtcatcaggtggcttctggacctggctgacaggtgcacgctcaaatgcattgccaccaccagattttccacttccgggagtcaccattcctcctccattacctgatcatgtggagcctggcaagacaagagtcacaacacttccaaatggtgtaaaaattgcctccgagacatctccaggttcaacttgttctgttggagtttatgttaattgtggttctgtatatgaagcacctgaaacattgggtgccactcagctgttgaagaagttggcctttacaaccactacaaacaggagccacttgcgtgttgtgcgtgaaattgatgcagtaggtggcaaggccagtgcatcggccaaccgtgagatgatgagctacagttatgctgccttgaagacttacatgcctgaaatggttgaagtgcttgttgattctgtgcgcaatcctgctttgcttgattgggaagtcaaggaacagataatgaaattaaaggccgagcttgcagaagcttcaagtaatccagaaactttccttttggaggctcttcactctactggttattctggtgctttggcaaacccattgattgcctcagaatcttcaattagcagattaaacacggatgttctagaagatttcttagctgagaactacacttcctcccgaattgttctagctgcatcaggtgttgatcatgatgaattggtatctattgctgagccgcttctttcagatattgcaaaggcagctagtaccataaaaccaaaatcggattacgtcggcggggagtatagacgcactgcggattcagcgaaaacagatgttgctctggcatttgagatccccggtgggtggctcagagaaaaagattttgttactgtatcagttcttcagacacttctaggtggtggtggtgtgttttcctggggaagatctggaaaaggcttgcattcaagattaaatcgcctcgttaatgaatttgaccaaatcaagtcgatatctgctttcaaggatgttcacagtaacactggcatttttggtattcatacatctactgaagcagcatttgttcctaaagctattgacttggcagccagagagctgacttccctcgcaactcctggtcaagttgaccaaacccaacttgatcgtgctaaagcatcagctaaatcagcaatcttgacaagcctagaatcaaaggcatcagcaactgaagacatggggcgccaagtattggcatttgctgataggaaacctgtggagcaccttcttaaggttcttgatggtgttactctgaaagatgtatcaactttcgctgagaaaattatttcatcaccattaacaatggcatctcatggaaacgttctcaatgtaccgacttacgatacagtgcgtggcaagttcagctcgaaatgagtaggcatttccccagccttctggacaagttaactgttcatatttttcctccaagatcacttgtggtcacattttcagaccaataaggaacatacagttttgatcattaactcctactccaggcctctttggaatcacctttttttgcggaacatgtatccacttgagttggtggtttaatgttgttctcataagttatctgcttgtaaattcggacaaattctgggtcctctttcggtggcagtccggaaagagtgtacaaatgttcatttactttcagctaaatcattgaaactagttttttggagcaaggaaatgaataagaaagaccacacgacggtgaaattttgca

SEQ ID NO: 1746 - DNA, 2051 bp, Zea mays
gcagcagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggcttctggacctggttgactggtgcgcgttcaaatgaaatacctcctccagatttcacacttccgggagtgactattcctcctccgctgcctgaccatgtggaggctggcaaaacaagagtcacaacacttcccaatggtgttaaaatagcctctgagacatctgcgggatcatcttgttctgttggagtttatgttgattgtggttctgtatatgaagcacctgaaacaacaggcgccagtcaactgttgaagacaatggccttcacaaccactgccaacaggagtgagttgcgggttgtgcgtgaaattgaggcaataggtggcagtgccaaagcatctgctagccgtgagatgatgagctacacttacggagccctgaagacttacatgcctgaaatggttgaggtgcttattgattgtgtacgcaaccctgcttttcttgattgggaggtcaaggaacagattttgaggctacaggcagagcttgcaaaatcatcaagttatcctgaaaattttcttttggaggctcttcattctactggctattctggtgctttagcaaacccactaattgtgccagaatattcagttagcagattgaatgcagatgtcctggagcaatttataactgagaactacactgcttcccgaattgttctagctgcatcaggtgttgatcatgatgaattggtatctattgccgaaccccttctgtctgacattcccagtgtatctggaacaacaaggccaaaatcaacctacattggtggagaatacagaagaagtgcagattcatcgaacacagacgttgcattggcattcgaggtcccaagtggttggctcaaagaaaaagattgcgtcactgtatcagttcttcaggcacttctgggtggtggtggcaagttttcttggggaaggcaaggaaaggggttacattcacgtctaaaccgcctcgtaaatgaatttgatcagatcaagtcaatctctgctttcaaggatgttcacagtaatactggcatctttggaatccatacatctactgatgcatcatttgttcctaaagctattgacctagcagccagagagctcacttcccttgcaactcctggacaagttgaccaaagccaactggaccgtgctaaagcctcagctaaatctgcgatactggcaaatttggaatcacaggcatcgctaacagaggacatggggcgccaagttttggcatttggtgaaaggaaacctgctgagcaccttctcaaggctgtagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattttatcaccttgtttgctggacaagttttaccagtcccttgtcattcacgtctaggccatggttcttggtcagtttcagaagaaataaggaacctcatgcagttttgttcgtgaaacctgtgatcacttcacaattattcccttttctcattcttttgcggaacattcgtgtggttaatgctggtgatagaccagtaacgtgcttgtaaatttaactgaaccctggcccctcattcggtaccaaggccccaagagaatgtacaaaattgtcgtaaaactcttgacaaaaatgttgtcgcacatgaataatgattctacagaactgaagtttgcatgagtcgtgtactcgtgttcgatgc

SEQ ID NO: 1747 - DNA, 1922 bp, Pennisetum glaucum
gccggcgaccatgtaccgcgccgtctctagcctccgggccatcaagaggcatagggcagatgctcaaatgatgaatattgcaattaggtctgccagcacaagtgttgcacggagctcatcaggtggcttatggacttggttgactggtgcacgctcaaatgcattacctcctccagatttcgaacttccaggagtgactattcctcctccactacctgatctcgtggagcctggcaagacaaaaatcacaacacttgacaatggtgtaaaaatagcctctgagacatctgcaggaccctcttgttctgttggagtttatgttgattgtggttctgtttatgaagcacctgaaacaacaggtgccagtcagctgttgaagacactggccttttcaaccactaccaacaggagtgaattacgtgttgtgcgtgaaattgaggcaataggtggcattgccaaagcatctgctagccgtgagatgatgagctacacgtatggagccctgaagacatacatgcctgaaatggttgaggtgcttattgattgtgtacgcaaccctgcttttcttgactgggaggtcaaggaacagattttgaaactcaaggcagagcttgcaaaagcctcaagtaaccctgaaaaattgcttttggaggcccttcattctactggctattctggtgctttggcaaaccctctgattgcgccagaatcttcaattagcagattgaatgcagatgtcctagaacagttcatagctgaaaactacactgctccccgaattgttctagctgcatcaggtgtggatcatgatgaattggtatctattgctggaccacttctgtctgacattcccaatgttgctggaaccacaaggccaaaatctacgtatgttggtggagaatatagacgaactgcagattcatcgaacacagatgttgcgttggcatttgaggtccctagtggttggctcaaagaaaaagactttgtcactgtatcaattcttcagacacttctgggtggtggcggcaccttttcttggggaaggcagggaaagggattgcattcacgtttaaatcatcttgttaatgaatttgaccaaatcaagtcaatctctgctttcaaggacgttcacagtaacactggcatcttcggaattcacacatctactgatgcatcatttgttcctaaagctattgacctagcagccagagagctcatttcccttgcaactcctgggcaagttgagcaaagtcaactagatcgtgctaaagcatcagctaaatctgcaatattagtgaacctggaatcgaaggcatcactaacagaagacatggggcgccaagtactggcatttggcgaaaggaaacctgttgagcaccttctcaaagcggttgatgctgttaccctggaagacgtaacagcagctgctgaaaagatcatctcatcgccactaacaatggcatcccatggaaacgttctgaatatgccaacctatgagtccgtcagtggcaagttcagctcgaaatgagtgcctgggccttctttttctctccctgctggacaagtttaacagcccgtatgtttcacgcctaggccatcattcttggtcaaagtttcgtcagaagaaaaataaggaacctcagtacaattttgttcgttaaaactttgctcactttttcaactacactttcactccccctttcttttgcggaaacattcatccatccacttgaattggtggttattgctggtgataggccagtcgtgtttgtaaatttaaccgatcaccagggctcttctttcatttacgaggcccgaaagagtgtacaaaaataccattcctcttgccggaaaatcttttgacgagaatgtcgaagcacatgaataatgactctacaggatggtgaaatttggcacgattt

SEQ ID NO: 1748 - DNA, 2053 bp, Sorghum bicolor
cgagtctcgagtctcgagagtgagttcgattcgttgccgtccacttgtctcacgtcacggcctgtcgccatctccttcctggttgctccatccctgcctcctcggcgccgccggcgacgactccatagagccactcggccacaggaaccggcgaccatgtaccgagtcgcctccggcctcggcgccctcaagaggcatggggcagatgctcaaatgatgaatgttgcaatcaggtgtgccagcacaagtgttgcacaagggtcatctggtggcttctggacctggttgactggtgcacgctcaaatgaaatacctcctccagattttgcacttccgggagtgactattcctcctccgctacctgatcatgtggaggctggcaagacaatagtcacaacacttcccaatggtgttaaaatagcctctgagacatctgcaggatcatcttgttctgttggagtttatgttgattgtggttctgtatatgaagcacctgaaacaacaggcgccagtcaactggtgaagacaatggccttcgcaaccactgccaacaggagcgaattgcgggttgtgcgtgaaattgacgcaataggtggcactgccaaagcatctgctagccgtgagatgatgagctacacttacagggccctgaagacttacatgcctgaaatggttgaggtgcttattgattgtgtacgcaaccctgcttttcttgattgggaggtcaaggaacagattttgaggctaaaggcagagcttgtgaaatcatcaagtaatcctgaaaaattccttttggaggctcttcattctactggctattctggtgctttagcaaacccactaattgcatcagaatatgcaattagcagattgaattcagatgtcctggagcaatttataattgagaactacactgctccccgcattgttctagctgcatcaggtgttgaccatgaagaattggtatctattgctgggccccttctgtctgacattcccagtgtatctggaacaacaaggccaaaatctacttacataggtggcgaatacaaaaaaagtgcagattcatcgaacacagatgttgcattggcattcgaggtcccaagtggttggctcaaagaaaaagattttgtgaccgcatcagttcttcagacacttctgggtggcggtggcaaattttcttggggaaggcaaggaaaggggttgcattcgcgtctaaaccatctagtaaatgaatttgatcagatcaagtcaatctctgctttcaaggacgttcacagtaatactggcatctttggaatccatacatctactgatgcatcatttgttcctaaagctattgacctagcagccagagagctcacttcccttgcaactccaggacaagttgaccaaagccaactagaccgtgctaaagcctcagctaaatcagcgatactggcgaacctggaatcgcaggcatcactaacagaagacatggggcgccaagttttggcatttggtgaaaggaaacctgctgagcaccttctcaaggctattgacggtgttactctgaaagatgtaacatctgttgctgaaaagatcatttcatcaccattgacaatggcatctcatggaaacgttctgaacatgccaacttatgagtcggtcagtggcaagttccgctcaaaatgaggagtacatgacccttcattttatcaccttgtttgctggacaagtttagcagtccattgtcattcacgcctaggccatgattcttggtcagtttcagaagaaataaggaacctcatacagttttgttcgttaaatctgtgatcatttcacaattactcctttttccctttcttttgcggagcattcatgatgttaatgctggtgatagaccagtaacgagcttgtaaatttaactgaaccctggccccctctttcgatgacaaggccccaaaagagtgtacaaaattttcgtaaaacctttgacagaaatgttgaagcacatgaataatgattctacagaactgaagtttgcatggttcgtgttcgaggcaacaaatgg

SEQ ID NO: 1749 - DNA, 2092 bp, Saccharum officinarum
cggacgcgtggggccgtccacttgtctcacggcctgtcgccgtctccttcctgagttcctggttgctccatcccccgcctcctccacgccgccggcgacgattccatcgagccactcggccacaggaaccggcgaccatgtaccgagtcgcctccggcctcggcgccctcaagaggcatggggcagatgctcaaatgatgaatgttgcaatcaggtgtgccagcacaagtgttgcacaagggtcgtctggtggcttctggacctggttgactggtgcgcgctcaaatgaaatacctcctccagatttcactcttccgggcgtgattattcctcctccgctacctgatcatgtggaggctggcaagacaagagtcacaacacttcccaatggtgttaaaatagcctctgagacatctgcaggatcatcttgctctgttggagtttatgttgattgtggttctgtatatgaagcacctgaaacaacaggtgccagtcaactgttgaagacaatggccttcgcaaccactgccaacaggagcgaattgcgggttgtgcgtgaaattgaggcaataggtggcagtgccaaagcatctgctagccgtgagatgatgagctacacttacggggccctgaagacttatatgcctgaaatggttgaggtgcttattgattgtgtacgcaaccctgcttttcttgattgggaggtcaaggaacagattttgaggctaaaggcagagcttgcgaaatcatcaagtaatcctgaaaaattccttttggaggctcttcattctactggctattctggtgctttagcaaacccactaattgcgtcagaatatgcaattagcaaattgaatgcagatgtcctggagcaatttataattgagaactacactgctccccgaattgttctagctgcatcaggtgttgatcatgatgaattggtatctattgctgaaccccttctgtctgacattcccagtgtatctggaacaaggccaaaatctacctacattggtggagaatacagaagaagtgcagattcatcgaacacagatgttgcattggcattcaaggtcccaagtggttggctcaaagaaaaagattttgtgaccgtatcagttcttcagacacttctgggcggtggtggcaaattttcttggggaaggcaaggaaaggggctgcattcacgtctaaaccatctagtaaatgaatttgatcagatcaggtcaatctctgctttcaaggacgttcacagtaatactggcatctttggaatccatacatctactgatgcatcatttgttcctaaagctattgacctagcggcaagagagctcacttcccttgcaactcctggacaagttgaccaaagccaactagaccgtgctaaagcctcagctaaatcagcgatactggcgaacctggaatcgcaggcatcactaacagaagacattgggcgccaagttttggcatttggtgaaaggaaacctgctgagcaccttctcaaggctattgatggtgttactctgaaagatgtaacatctgttgctgaaaagatcatttcatcgccattgacaatggcatctcatggaaacgttctgaacatgcctacttatgaatcggtcagtggcaagttccgctcaaaatgaggagtacatgacccttcattttatcacctttttttctggacaagtttagcggtcccttgtcattcacgcctaggccatgattcttggtcagtttcagaagaaataaggaacctcatacagttttgtttgttaaatctgtgatcacttcacaattaccttctttttccctttcctttgcggaacattcatgtggttaatgatgctggtgatagaccagtaacgagcttgtaagtttaactgaaccctggtccctctttctgtgacaaggcccccaaagagtgtacaaaattttcgtaaacctttgacaaaaatgttgaagcacctgaataatgattctacagaataaatataaatatactgataatgatttgaatgacgttgttgtttcacaattaaaattattcattttcttttatatttttcattcatatagtgggccg

SEQ ID NO: 1750 - DNA, 1991 bp, Panicum virgatum
ccatctcctcccttccgcatctccgccaccagccatcctccccctccacgccgccggtgacgactccgtcgagccactccgcagcaggcgccggcgaccatgcaccgcgccgtatcgggcctcagcgccctcaagcggcatagggcagatgctcaaatgatgaatattgcaattaggtctgccagcacaagtgttgcacagagctcatcaggcggcttctggacttggttgactggtgcacggtcaaatgcattacctcctccagatttcgcgcttccaggagtgactattcctcctcctctacctgacctcgtggagcctggcaagacaaaaatcacaacactttcgaatggtgtaaaaatagcctctgagacatctgcaggatcatcttgttctgttggagtttatattgattgtggttctgtatatgaggcacctgagacaacaggtgtcagtcagctgttgaagacaatggcctttgcaaccactaccaacaggagtgaattgcgcgttgtgcgtgaaattgaggcgataggtggcagtgccaaagcatctgcaagccgtgagatgatgagctacacttatggagcgctgaaaacatacatgcctgaaatggttgaggtgcttgttgactgtgtacgcaatcctgcttttcttgattgggaggttaaggagcagattttgaggctcaaggcagagcttgcaaaagcatcaagtaaccctgaaaatttccttttggaggctcttcattctactggctattctggtgctttggcaaaccctctgattgcatcagaatctttgattagcagattgagtacagatgtcctgggacagtttatatttgagaactacactgctccccgaattgttctagctgcatcaggtgttgatcatgatgaattggtatctattgctgaaccgcttctgtctgacattcccagtgtaactggaaccacaaggccgaagtctacttatgttggcggcgaatatagacgaactgcagattcatcgaacacagatgttgcgttggcatttgaggtccctggtggttggctcaaagaaaaagattttgccactgtatcagttcttcagacacttctgggtggtggtggcacgttttcttggggaaggcagggaaagggattgcattcacgtctaaatcaccttgtaactgaattcgaccaaatcaagtcaatctctgctttcaaggatgttcacagtaacactggcatctttggaattcatacatccactgatgcatcatttgttcctaaagctattgacctggcagccagagagctcacttcccttgcaactcctggacaagttgaccaaagccaactggatcgtgctaaagcctcagctaaatctgcaatattagtgaaccttgaatcaaaggcatcactaacagaagacatggggcgacaagtactggcatttggtgaaaggaaacctgttgagcaccttctcaaggctgttgatggtgttactctgaaagacgtaacaacagttgctgaaaagatcatttcatcaccgctgacaatggcatcccatggaaacgttctgaatatgccaacttacgagtcggtcagtggcaagttcagctcgaaatgagtacatgggcgtttctatttctctgtctggacaagtttaacagcccgtattttccacacctaggccattattctcggtcaaagtttcatcagaaaaataaggaacctcatacaattttgttcgttaaatctttgctcactttgcaattacttgttcccctccacttctttttgcggaaacattcgtccacttgagttggtggttattgctggtgataggccagtcatgtgtttgtaaatttaactgataccggggctactctttcgtttacaaggcccaaagagtgtacaaaataccattgtctggtcctaaaatctttgacaagaaagtcgaagcacatgaataatgattctactgggctgtgaaattttgca

SEQ ID NO: 1751 - DNA, 2016 bp, Panicum virgatum
cctccctctcgcatctccgccaccagcccacctccccctcggaccccgccgccggtgacgactccgtcgagccactccgcagcaggcgcaggcgaccatgcgccgcgccgtatcgggcctcagcgccctcaagaggcatagggcagatgctcaaatgatgaatattgcaattaggtctgccagcacaagtgttgcacagagctcatcaggcggcttctggacttggttgactggtgcacgctcaaatgcattacctcctccagatttcgcacttccaggagtgactattcctcctcctttacctgatctcgtggagcctggcaagacaaaaatcacaacgctttcgaatggtgtaaaaatagcctctgagacatctgcaggatcatcttgttctgttggagtttatattgattgtggttctgtatatgaggcacctgagacaacaggggtcagtcagctgttgaagacaatggcatttgtgaccactaccaacaggagtgaattgcgcgttgtgcgtgaaattgaggcgataggtggcagtgccaaagcatctgctagccgtgagatgatgagctacacttatggagcgctgaagacatacatgcctgaaatggtcgaggtgcttattgactgtgtacgcaaccctgcttttcttgattgggaggttaaggagcagattttgaggctcaaggcagagcttgcaaaagcatcaagtaaccctgaaaaattgcttttggaggctcttcattctactggttattccggtgctttggcaaaccctctgattgcatcagaatcttcgattagcagattgaatacagatgtcctggaacagtttatatttgagaactacactgctccccgaattgttctagctgcatcaggtgttgatcatgatgaattggtatctattgctgaaccgcttctgtctgacattcccaatgtaactggaaccacaaggccgaaatctacctatgtgggcggcgaatatagacgaactgcagattcattgaacacagatgttgccttggcatttgaggtccctggtggttggctcaaagaaaaagattttgccactgtatcagttcttcagacacttctgggtggtggtggcacgttttcttggggaaggcagggaaagggattgcattcacgtctaaatcaccttgtaactgaatttgaccaaattaagtcaatctctgctttcaaggatgttcacagtaacactggcatctttggaattcatgcatctactgatgcgtcatttgttcctaaagctattgacctggcagccagagagctcacttccattgcaactcctggacaagttgaccaaagccaactggatcgtgctaaagcctcagctaaatctgcaatattagtgaaccttgaatcaaaggcatcactaacagaagacatggggcgtcaagtactggcatttggtgaaaggaaacctgttgagcaccttctcaaggctgttgatggtgttactctgaaagacgtaacgacagttgctgaaaagatcatttcatcaccgctgacaatggcatcccatggaaacgttctgaatatgccaacctacgagtcggtcagaggcaagttcagctcgaaatgagtacatgggccttttatttctctgcctgctggacaagtttaacagcctgtactttcacacctaggccattattctcggtcaaagtttcatcaggaaaataaggaacctcatacaattttgttcgttaaatctttgctcattttgcaatcacttgttcccccaccttttttgcggaaacattcgtccacttgagttggtgattattgctggtgataggccagtcgtgtgtttgtaaatttaactgataccggcctacctgggctcctctttcgtttacaaggcccaaagagtgtacaaaaaaataccattctctggtcgtaaaatctttgacaagaatgtcgaagcacatgaataatgattctactggactgaaattttgcacgattcctattctgagctgt

SEQ ID NO: 1752 - DNA, 1984 bp, Triticum aestivum
gaattgtcgccttccacttgtctcacggtctccgtccccatctccccctccgccgctcccgccgcgccgccggcgacgaccccgtcgacagatctccaccggcgccctccatcatgtaccgagccgcctccggcctcggcgccctcaagcagcatggggcggatacccaactgttgaatatcgcggttaggtctgctagcacaagtgttgcacagaggtcatcgggcggcttcttgggctggctgacaggtgcacgttcaaatgcactaccccctccagatttcgcactcccaggagtcactattcctcctccactagctgatcatgtggagcctggcaagacaaaaatcacaacactttcaaatggtgtaaaaattgcctctgaaacatctccaggatcagcatgttctgttggagtttatgttcactgtgggtctgtatatgaaacacctgagacactgggtgccactcagttattaaagaagttggccttcacaaccactagaaacaggagccagttgcgtgttgttcgtgaaattggtgcaataggtggcagtgcgaaagcatcagccaaccgtgagctcatgagctacagttatggagcccttaagacttacatgcctgaaatggtggaagtgctagttgattgtgtgagaaatcctgctttacttgattgggaagtcaaggaagagataatgaaactaaaggcagagcttgcagaagcttcaagtaatccggaagctttccttttggatgctcttcattccagtggctattctggtgccttggcaaacccattgattgcctcagaggcttcaattagcagattaaatacagatgttctggaagaatttcttgctttgaactacacttccccgcgaattgttctagctgcgtctggtgtggaccacgatgaacttgtatcaattgctgaaccactcctgtctgacattcccactgcaactggaacaggaaagccaaaatctgtctatgttggtggagaatatagacgggcagcagattcatcgaacacagatcttgctttggcatttgagctcccaggtggatggctgaaagaaaaagaatttgctactgcatctgttcttcaggcacttctgggtggtggtggcgtgtttacctggggaagacctggaaaaggcttgcattcacgtctaaatcccctcgtaaatgaatttgaccaaatcaaatcgatctccgctttcaaaaatgttcacagtaacactggcatttttggaattcatacatcgactgaagcagcatttgttcctaaagttattgacttggcagccagagaactcacttcccttgctactcctggtcaagttgaccaaacccaactggaacgtgctaaagcatttgcaaaatcagctatcttgaagaacctggaatcaaaggcatcaacaactgaagacatggggcgccaagcattggcatttggtgaaaggaaacctgtggagcagcttcttaaggctgttgatgctataactctggcagatgtatcaactgttgctgagaagatcatctcgtcaccattgacaatggcatctcatggaaatgttctcaatgtaccagcctacgagacagtgcgtggcaagttcagctcgaaatgaggaggcttctgaacaagttaactgttcatatttatttttctccaagacctggtcacatttttcacaagaaaaataagatgcatacaattttggttattaactcctctactgtgggataactttgggatcttatttttttttcctcgcaaaacatgtatccacctgaatttgttggtgtgatgttctcaagagatatgttcctgtaaattcagtgaaatcatatatgggtggccctctttcagtggcagtccggaagggtgtacaaaatgttcctccacttttttgggttaaagtcgatgaaaccagtgtcggggcacagaaatgaataaagattcaatatgacgtgaaatttt

SEQ ID NO: 1753 - DNA, 1446 bp, Brachypodium distachyon
ggcaatggccgacggcggcgggctggaggagcaggctgcggcggcggcggaggcggcgcgggagctgcgggaggcggcggcggggatggccgcgcgcagggccgccgaggaggacgcgctgcggaggcgcgcggcggcgctggacggggacgtgcgcaggctccagggctcgctcgccagcctcgaccccgccacgctcgaaaaggtcgaggaagatctggagcgtgccagggcagcaatcttagatggtgatgtggccggattgctcccaagcaagggaagcgggaagttccttaagaagtttcttggccctgtgaatgtgagggtggcaaggaaggaagataagctcaaagtgaaggatgagtacaataattatagggatagggccgcttatatttttctgttgtttccatccactctcctcctactgagatggtgggtgtgggatggatgccttccagcattggcagttcaggtttaccaggcttggctattattcctctacacaagttttgctttgcgggagaatgtgttgcttgtaaatggaagtgatattcgtccttggtggatataccaccactatttagcaatgctgatggctcttgttagcctaacatgggagataaagggacagcctgattgttcgagcaagcagaggggggttcaacttttcctgcgctgggcaatcatgcaaggaatcgcaatgcatctacagaataggtaccagcgtcaaagattacgcacccggatagctctaggaaaggctaaaaggatggatgttgttgctggagaaacagctggtgtggaagggcagctcttgctgctatatcctgtcctttttgtattacagggttttgaagcatatgttggagtactgcttcttcagacggcttggcatgggctcacctccgaatggcaggttgtagtatgtgggatcttgctggtggtaatggcagttggtaactttgtcaacacggtagagactttggccttaaaactgaggttcaaagcaaagatgaagagaacaaggaacaggccagaccagagccagggccagggcggtccaaatcgcccacatcaaaattgagaaagcgtcactgtccgggatggtcaccccatgcctggaaacaacaatgctgacacggtctcttctgtaaatcctttaatcagtaatactaccattttttgattggtcgtgactttctgttgttagtagaattggtccccatttaacactgaagttgtactgtgttaatgcatgatacaataatcgcgtttttcctcggacaaaatccaagttgatgtaatcaatatattgactgttgcttgcccaaaccttttgaccaagataatgatccatctgagtaggcagtgtgggtccaatgtttaatgatcataatactggtttgtttcagagttaatgtcatgagtagtaccattgtactc

SEQ ID NO: 1754 - DNA, 1420 bp, Zea mays
aaaaccgaaatccaaattccaattcaatccctccgtcgctcgctccaatcatccccaccgcttcaccgcccgcgccacccaatgtcaggcgacggcgacgcgcgcggcctcgaggcagcggcggccaccgcggcagaggcggcgcgggagctgcgcgaggcggccgcggccctcgtcgccacccgcgccgctgaggaggacgcgctgcgccgccgcgccgtggcgctcgaagccgacgtccgccgcctccaggcctcgctccacgccctcgatccctccacgctcgacaaggtcgaggaggaattggagcgtgccagggtggcaatcacggatagtgatgtggcttcgtttcttcccagcaagcggaatggcaagtttcttaagacatttctaggccctgtgaatgtgcgggtggcgaggaaggaagataaactcaaaatcaaggatgagtacaacaattatagggataggacagcctataagtttctgttatttccatctatcctcctcctactgagatggtggatatgggatggatgccttccagcattggctgttcaaatttaccaggcttggttactatacctgtacacaagctttgctttgcgtgagaatgtattaattgcgaatggaagtgacattcgtccatggtggatatatcatcactatctagcaatgctgatggctcttattagccttacatgggagataaagggacagcctgattgttctagcaagcagaggggggtgcaacttttcttgcgctgggcaatcatgcaaggcattgcaatgcatctacagaatagataccagcggcaaagattgcgtactcgaatagctctaggaaaggctaaaagaatggatgtcgttgctggcgaaacagctggtgtggaggggcagctcttgctgctatatcctgtccttttcatattacagggtttcgaagcatatgttggagttttgcttcttcagacggctttgcatgggcttgcttccgaatggcaggtcttagtctgcgggatcttgctggtggttatggcagtcggcaactttgtccacactatggagacactggtactgaaactgaggtttaaagcaaagatgaagaaagcgaagagcagacaggatcgcccgcatcaaaattgacaggcatcatcgtccttggaaaacaaggatgctgacaccgcctcttttgtaaatcctttgacccacattaacattttttgcctgcttgtcattctctctctcttttttttttggtaattggccctgtaacattgaagttgatattccacacaacacggtggatgaaaccatatttgttcgctcttggatgagaactgagtttggcatgtactatatatttttctgtatgaaacctctgggttctgaaataagatgatgtgtatctgaagctgtg

SEQ ID NO: 1755 - DNA, 1559 bp, Sorghum bicolor
attccatccaattccaaattccaatccaagatctctctagtctctgctcttcctccgtcgcacgcacgcacgcctcagcagtcgcaggtcgcagggcagggccccaccgctccaccgccccgcgccagccaatgtcaggcgacggggacgcgcgcggcctcgaggcggcggcgtccgccgcggccgaggcagcgcgggagctgcgggaggcggccgcggccctagtcgccacccgcgccgccgaggaggacgcgctgcgccgccgcgccgtggcgctcgacgccgacgtccgccgcctccagggctcgctccacgccctcgactcctccacgatcgacaaggtcgaggaggaactggagcgtgccagggtggcaatcacggatagtgatgtggcttcgtttctacctagcaagcgaaatgggaagtttcttaagacgtttctaggccctgtgaatgtgcgggtggcgaggaaagaagataagctcaaaatcaaggatgagtacaacaattatagggataggactgcctataagtttctgttgtttccatctatcctcctcctactgagatggtggatatgggatggatgccttccagcattggctgttcaaatttaccaggcttggttactatacctgtacacaagctttgctttgcgtgagaatgtattaattgcgaatggaagtgacattcgtccatggtggatatatcaccactatctagcaatgctgatggctcttattagccttacatgggagataaaaggacaacctgattgttctagcaagcagaggggggtgcaacttttcttgcgttgggcaatcatgcaaggcattgcaatgcatctacagaacagataccagcgccaaagattgcgtactcgaatagctctaggaaaggctaaaagaatggatgtcgtcgctggagaaacagctggtgtggaggggcagttgttgctgctatatcctgtccttttcatattacagggttttgaagcatatgttggagttttgcttcttcagacagctttgcatgggcttgcctcccagtggcaggttgtagtctgcgggatcttgctggtggttatggcagtcggcaactttgtcaacactatggagacactgctcctgaaactgaggttcaaagcaaagatgaagagagcaaagaacagacaggatcgcccacatcaaaattgacaggcatcatggttcctggaaccatcggtttgtaaatcctttgagctgtattaaaggattttcaatgttcctggaaccatcggtttgtaaatcctttgacattgaaaattgacagagcaaagctgacaccatcggtttgtaaatcctttgacctgtattaacatttttgcctgcttgtaattctctgttttggtaattggccctgtaacattgaagttaatattccacacaacacgacggatgaagacaatatttcctcttcctcagatgaaaattgcgagtttgcgctgtactatgctttctgtttaaaacatatggggtcctgaaataggacaataataataatgtatgtatctgaagttg

SEQ ID NO: 1756 - DNA, 1192 bp, Panicum virgatum
gccctcgtagccacgcgcgcagccgaagaggacgcgcttcgccgccgcgccgtcgcgctcgacgccgacgtccgccgcctccagggctcgctccccgccctcgacccatccgcggtcgacaagatcgaggaggaattggagcgtgccaaggcagccatcacagatagtgacgtggcttcatttctccccagcaagcgaaatgggaagttccttaagatgtttctaggccctgtgaatgtgcgggttgccaggaaggaagataagctcaaaatcaaggatgagtacaataattatagggataggactgcctataagtttctgctgtttccatctatactcctactactaagatggtggatatgggatggatgccttccagcttgggcagttcagatctaccaggcttggttactattcctgtacacaagctttgctttgcgggagaatgtattgattgcaaatggaagtgacattcgtccatggtggatatatcaccactatctagcaatggtaatggctcttattagccttacatgggagataaagggacaacctgattgttctagcaagcagaggggagtgcaactcttcctgcgttgggcaatcatgcaagggattgcaatgcatctacagaacagataccagcgtcaaagattacgcactcgcatagttctaggaaaggcaaaaagaatggatgttgttgctggagaaacagcaggtgtggaggggcagctcttgttgctatatcctgtcctttttatattacagggttttgaggcgtatgttggagttttgcttcttcagacagctttgcacggacttgcctctgaatggcaggttgtagtttgtgggatcctgctggtggtaatggcagtgggaaacttcgtcaacactgtggagacactgatattgaagttgaggttcaaagcaaagatgaaaagagcaaagagcaggcaggaccgcccgcatcaaaattgacgaaggcagaatgctgacaccatctcttttgtaaatcctttgacccgtaaaacattttttggctgcttgtaattccctgttttggtatttggccctgtaacattgaagttgataccctatacaaacacgaagaaagatacagatatttcctcttcagatgaaaattgcgagttttccatgtatgtatgcttcagctctaaatatttgagttttg

SEQ ID NO: 1757 - DNA, 1635 bp, Triticum aestivum
  misc_feature (1516)..(1516): n is a, c, g, or t
  misc_feature (1525)..(1525): n is a, c, g, or t
  misc_feature (1544)..(1544): n is a, c, g, or t
  misc_feature (1564)..(1564): n is a, c, g, or t
  misc_feature (1578)..(1578): n is a, c, g, or t
  misc_feature (1626)..(1626): n is a, c, g, or t
  misc_feature (1632)..(1632): n is a, c, g, or t
agaagcttctctctctctccaacctcctccgccaccgccgcgccgcaccgcccatctctcctgctcctcgtcggcggcaatggacggcggaggtgacggggcccagggcctggaggagcaggcggcggcggcggccgaggcggcgcgggagctgcgggacgccgcggcggccctcgccgtgcgccgcgccgccgacgaggacgcgctgcggcgccgcgccgtcgcgatcgacgccgacgtccgacggctccagggctccctcgcccccctcgaccccgccacgctcgacaaggtcgaggaggaactggagcgtgccagggcagcaatcttggacggcgacgtggctgcgtttctcccaagcaagggaaatggaaagttccttaagaagtttgttggccctgtgaatgtgcgggtggcaaggaaggaggataagctcaaagtgaaggacgagtacaacaattatagggatagggctgcctatatgttcctgttgtttccatccactctcctgttactgagatggtgggtgtgggatgggtgccttccagcattggcagttcaggtgtaccaggcttggttattattcctctacacaagttttgctttgcgggagaatgtgttgcttgtaaatggaagtgatatccgtccttggtggatataccaccactatttagcaatgctaatggctcttgttagccttacttgggagataaagggacagcctgattgctcgagtaagcagagaggggtacagcttttcttgcgttgggcaatcatgcaaggaattgcaatgcatctacagaataggtaccagcgtcaaagattacgcacccgaattgctctgggaaaggctaaaagaatggatgtcgttgctggagaaacagctggtgtggaagggcagctattgctactatatcctgttctttttgtattacaggggtttgaagcatatgttggagtgttgcttcttcagacggcttggcacgggctcacctctgaatggcaggtcatagtttgcgggatcttgctggtggtgatggcggttggcaacttcgtcaacacggtggagacactggccctgaaactgaggttcaaagcaaagatgaagaggacaaggcacaggcaggagcctggccagggcggtgcgaatcgcctgcatcaaaattgacaatccagtctggtggcactcctccatgcctggaatggagacagcaacactgacaaaaccatctcttctgtaaatccttaaatcggtacaccattttttgttccgtgtgtgctcgtggtttttctttttctcttatatcagtaaattcggccccgtagcaatttggtcccatactctgttgcatgcacgatacggcgactcgacggacaataatcgcactttcaagttggtgcaatcattgtgtattattattgactgttgcttgtcagcacttttgacagcaggcatgcttgaacaaatgtctcagtagtaaaaaaaggggggcccggtaccaatcgccatagtgancgtataccncgccacggcgtctttaaantcgtgacgggaaaacctggnttaccaattaacgnctgcacacaccccttccagtgcgtatacaagagcccacgttcctccanattgcnagg

SEQ ID NO: 1758 - DNA, 2863 bp, Oryza sativa
aattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacgttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatcaacttgtcggggcttggattaagcggcacgctaggttatcagctatcgagcttgaaatcagtaaccaaattcgatgtcagcaagaacaatttaaatggtgaaatcccataccagcttccaccaaatgtggttcagttaaatcttcgaggaaatgccttcagcggtggtgttccttattcgatatctcagatgactgatctggaaacgctaaatcttggtaagaatcaattgagcgggcagttgacagatatgttttctcagctgccaaagcttacaacaatggatttgtcattcaatagcttctcaggtaacctgcctccgagttttcaatacctcaagaacctcaaaacactagatgtggagagcaaccaattcagtggtcatataaatgtgctggccaaactttctcttgaggatctgaatgtgaagaacaacaagttcactgggtggatcccaagtaaactgaagagcattgacaatttagagactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcagggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtacctacatgaggtctgttcacctccagtgctccacaaaaacataaagtcttcaaatgtcttgcttgatgctgatctcaaccctcacctctcggattgcggcctttcattcttctatgaggacgcaagtgagaacttgggacctgggtacagtgctccagagtgctcaagaccatcagcttacgtgatgaagagcgatgtctacagcttcggagtcatcatgctggagctactaaccggccgaaagccttatgatagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactacttatgagaccaaatctcacaacacagctaaaaacagccgtttcctagcaacagaagatccaagcttaactagcaaactatagatgaatttgcagaactcatctagtcttgcacatagtacccaaaccgagtatacattgtcacacagattacagggctacaacaaaatgaaatgggtgcactcaatcactgcagcatgacattgaagtttgaacatacactagggggtacattgctaggggaagtatttcacatcgcagtggccatgatagtttcatttcctctgcacactctactcaaaactttcctaca

SEQ ID NO: 1759 - DNA, 681 bp, Antirrhinum majus
aaagagtaggtaatatattataaataatttgaagatttgtttccaatcaagcggaaaagtaaagaagtagggtttgtgggggatctgaatcatccatccatccatccatcagcttgccaatccgcaactgcaatgattcactttgttcttctcatcagcagacaggggaaagtgaggttgacaaaatggtattcaccctattctcaaaaggaaagaacaaaggttatccgagagcttagtggtacaattctcactcgaggccctaagctgtgcaactttgtggagtggagaggatacaaagttgtttacaaaagatatgccagcctttatttctgcatgtgtattgaccaggacgataatgaattggaagtccttgaaattatccatctctttgttgagatactagaccgctactttggaagtgtatgtgaactggatttaatctttaatttccataaggcttattatatattggatgaaattctgattgctggtgaacttcaagagtcgagtaagaaaactgttgcgcgtctaatagctgctcaggattctctggtagaggcggccaaggaggaagcaagttcaattagtaatatgatcgctcaggcaacaaaataagggtgcatttgaaagagagaaaaaatggcaagttttttatgtaatgtgtccatgtgccaggct

SEQ ID NO: 1760 - DNA, 742 bp, Malus domestica
cagagattagaagctcagagctgggtttcggtgaaagcttcgagctttgaagaagggcaagcaatcgatcgccacagagaacgcagccatgattcaatttgtgcttctaataagcagacaaggaaaagtgaggttgacaaaatggtattctccttatacccaaaaggaaagaagtaaggttctccgtgagctcagtggagtaattcttgcgcgaggtcccaaactctgtaattttgtggattggagaggatacaaagttgtttataaaagatatgccagtctgtatttctgcatgtgtattgatcaagaagataacgaattagaggtccttgaaatgattcatcattatgttgagattctcgaccgatactttggcagtgtctgtgaattggatttgatatttaacttccacaaggcctactatatactggatgaaattttgattgctggtgaacttcaagaatcgagcaagaaaacagttgcacgattgatagctgcacaggattctttggtggagactgcaaaagagcaggctagttcgataagtaatataatcgcgcaggcaaccaagtaatggagaacaagcatatggtcaccctttgtatcaatacacattgaagtgtttctgtattaatattgttcttgttatcgttattttgaaatttttatgatcaccgatgtgcgttgttggatacgctgtttaaggattgtacaataaaatgtttccgatttgtcgttgatt

SEQ ID NO: 1761 - DNA, 674 bp, arabidopsis lyrata
acagaaggattcattcgacgatcatcatcttctggagatctcttctgggaatcgagcttcgctgttcaatcggctaaaaatgatacatttcgtgctactagttagtcggcaagggaaagtaaggctcaccaagtggtattcgccttatacacagaaggaaagatctaaggtcatacgcgaactcagcggtgtgattctgaaccgaggtcccaagctctgcaattttattgaatggagaggatacaaggttgtctacaaaagatatgcaagcttgtatttctgcatgtgcattgatgaggcggataacgagttagaggtactggagataattcatcactacgtcgagatacttgaccgttactttggcagtgtgtgtgaactcgatttgatttttaacttccacaaggcgtattatatactcgatgagctgttgatcgctggtgaacttcaagagtcgagcaagaaaacagttgcaaggataatatcagcccaggatcaattggtggaagctgcgaaagaggaggcgagttccataagtaatataattgctcaggctaccaagtagagtctctttctgatctttacttacgcacttaaaacaatcgtaaatgatttgtttgtcatgtcatgtgtttgtttgattgactagaagaaagaagtattcatcgttttgg

SEQ ID NO: 1762 - DNA, 768 bp, Arabidopsis thaliana
atccaacaaacttatatgtgtatcggacacagaagaatactttcgacgatcatcagcttctggagatctcttctgggaatcgagcttcactgttaaagattttccttcaatcggctaaaaatgatacatttcgtgttactagtcagtcgacaagggaaagtaaggctcaccaagtggtattcgccgtatacgcagaaggaaagatctaaggtcatacgtgaactcagcggagtgattctgaaccgaggtcccaagctctgcaattttattgaatggagaggatacaaggttgtctacaaaagatatgcaagcttgtacttctgcatgtgcattgatgaggcggataacgagttagaggtactggagataattcatcactacgtcgagattcttgaccgctactttggcagtgtgtgtgaactcgatttgatttttaacttccacaaggcgtattatatactcgatgagctgttgatcgccggagaacttcaagagtcaagcaagaaaacagttgcaaggataatatcagcccaggatcaattggtggaagttgcgaaagaggaggcgagttccataagtaatataattgctcaggctaccaagtagtccttttctgaacttttcttatgcagctgaaacaatcgtaaatgagttaatattttccttaaactctgagatattctcttctgaatcacacttttgtttgtcatgtcatgtgattgtttgattgattagaagaaagaagcattcatcgttttgggtttaaaa

SEQ ID NO: 1763 - DNA, 793 bp, Arabidopsis thaliana
gcaaagagaatttttttcttgttgaggatcatcgattatcagtttctggatttcgctactacagatttgtcccgtcttgagttacgaaatcatgatacattttgtgcttctagttagccggcaaggaaaggtaaggctcaccaaatggtattctccttatgcacagaaggaaagatctaaggttatacgtgaactcagtggagtgattctgaatcgaggtccaaagctctgcaattttgttgaatggagaggatacaaagttgtttacaaaagatatgcaagtctctacttctgcatgtgcattgatcaggaggataacgagttagaggtccttgagatcattcatcactatgttgagattctcgatcgctattttggaagtgtgtgtgaactcgatttgatttttaacttccacaaggcatattacatattggatgagctcttgattgctggggagcttcaagagtcaagcaagaaaacagtagccaggattatatccgctcaggatcaactggtggaggttgcaaaagaggaggccagttcgataagtaatataatcgctcaggctactaatcgataagtagtcttattcatcatctatgcattcttatgcagttaaagtatgttccctgtctctggctacagtaattgttttgagaaatctttatccatttgatttttcttgcggagggattttcgtcttaaagcgtaacttggagagaagaaatatgttatgatttggttcataaacaagtaaagattatatcgtttgtaatctttgatttcatgtttt

SEQ ID NO: 1764 - DNA, 791 bp, Brassica oleracea
gattcattcattcattgttagacgggacgatcattcatcagcgtcgggagatctcttctgggaatcgaggataaacatgatacatttcgtgcttctagttagtcggcaaggaaaagtgaggctcaccaagtggtattcgccttatacacagaaggaaaggtctaaggtcatacgcgaactcagcggtgtcatcctcaaccgaggccccaagctctgcaatttcatcgaatggagaggatacaaggttgtctacaagaggtatgcaagcctgtatttctgcatgtgcattgatgaggcggataacgagttagaggtactggagattattcatcactatgtcgagattcttgaccgttactttggcagtgtttgtgaactcgatttgatttttaacttccacaaggcgtattatatattggatgagctgttgatcgccggtgagcttcaagagtcgagcaagaaaacagtggcgaggataatatcagctcaggatcaattggtggaggctgcgaaagaggaggctagttccataagtaacatcattgctcaggctaccaagtagtttctttctgatttgttgttaaaaaagcatcgttaatggtttaattatttgcttattttctgagaaattctattctaaatcacacttttctttgtccatgtcatgtcatgtgttttatctgtttgataagaaacatttattgatccttgtgggtttatgagtagtgattcctttgtaatgaccacatacagtacattctttgggatctaccatgattgataagaatact

SEQ ID NO: 1765 - DNA, 728 bp, Brassica rapa
gattcattgattgttagacgggacggacgatcattcatcagatctcttctgggaatcgaggataaacatgattcatttcgtgcttctagttagtcggcaaggaaaagtgaggctcaccaagtggtattcgccttatacacagaaggaaaggtctaaggtcatacgcgaactcagcggtgtcatcctcaaccgaggccccaagctctgcaatttcatcgaatggcgaggatacaaggttgtctacaagaggtatgcaagcctgtatttctgcatgtgcattgatgaggcggataacgagttagaggtactggagattatccatcactatgtcgagattcttgaccgttactttggcagtgtttgtgaactcgatttgattttcaacttccacaaggcgtattatatattggatgagctgttgatcgccggtgagcttcaagagtcgagcaagaaaacagtggcgaggataatatcagctcaggatcaattggtggaggctgcgaaagaggaggctagttccataagtaacatcattgctcaggctaccaagtagtgtctttctgatttgttgttaaaaagcatcgttaatggtttaattatttccttattttctgagaaattctattctaaatcacacttttcttttccatgtcatgtcatgtgttttatctgtttgataagaaacatttattgatccttgtgggtttacgagtagtgattcctttctc

SEQ ID NO: 1766 - DNA, 673 bp, Musa acuminata
ttcgtcgtcttcgctctgtcggaacgcgagtttgcagtcggtcaatctgagggccgaaagtagcaagactagaagcggctcaggaggaggaaggacgcggaagagagatgattcactttgtacttctaattagtcgacaaggaaaggttagattgacaaaatggtattctccttattcacagaaggaaagaaccaaggtcattcgagagcttagtgggttgatacttgcacgaggcccaaagctttgcaactttgttgaatggagaggatataaggttgtctatagaagatatgccagtctttacttctgcatgtgcatcgatgcagatgacaacgaattagaaattcttgaaataatccatcattttgttgagatactggacagatactttggcagtgtttgcgagctggatttgatattcaactttcataaggcatactacatactggatgaaattctcattcgctggggaactccaagagtcaagcaagaagaccgttgctcggcttatagctgcacaagactcactggtggaagctgcaaaggagcaggcaagttctgtaagcaatatgattgcacaggtcaccaaatagggttcctccagtttctgtatcacaattcccttcaaacttgttgatctcatctcatcgggactgtaattttctcaccaac

SEQ ID NO: 1767 - DNA, 977 bp, Hordeum vulgare
acccgacgcgacccagaccgcccgccgacgccgctcgcaccccccgtctctctatctcggcgaccctcccttctccgacgaccggctgccacccccgtccgccctcgccgccagatccgcgcggccacgcccaccctcacccgctcttcctctcgggcctcggcagatctacgcgggcggcggccgtccctagccatgattaatttcgtgctcctaatcagccgccagggcaaggtgaggctcaccaagtggtactcgccttacacccagaaggagaggactaaggtcatccgtgagcttagtgggctcattcttactcgaggtccaaaactctgcaactttgtcgagtggagaggttacaaggttgtgtacagaaggtatgccagcctctatttctgcatgtgtatcgatgctgatgacaatgagctcgaagtccttgaaattatccatcattttgttgagatactcgaccgctatttcggcagtgtatgcgagctggatttgatattcaatttccacaaggcctactatgtactggatgagattctcatttctggcgagcttcaggaatctagcaagaagaatgttgcaagacttattgctgcacaggattcgttggtggaggctgctaaagaggaagctggctccatcagtaacatcattgcccaggctacgaagtaaaagcctgcttctgatgatgcccctccgctctttgctttatgttcatgttggtaaatttgatgtaatagctccgttgatgtatccattttcccaaagaaacacgacttcctggattcggacctgttcagaatgagtgtcatgtaactacattgtgtgtgtgttcctttgcaactgaatttgggacccttcaagataaaattatcatggagattgttcgccagtaatctgtttagtggatatattaagaaatatttgtaaattcatgatcataattcagcagctcattctttgtgttt

SEQ ID NO: 1768 - DNA, 1375 bp, Ocimum basilicum
gtgaatagaagaggcatttggatcaacgctccgaccaccacctccgtcaacctgccaccgccgccatgctcttagctggtacgccattttcatgtatgagttgtattagtttgaccatgttccaccaacctagttcttaagatccactttgttcttctcattagccgacaaggaaaagtaagattgacaaaatggtactcgccatatactcaaaaggagaggacaaaggttatccgggagcttagtggtatgattctaactcgggcccctaagttgtgtaactttgtggaatggaggggatacaaagtcgtttacaaaaggtatgctagcctttatttttgcatgtgcattgatgagaatgataatgaattggagatccttgaaattatccatcattatgttgagatactagaccgctactttggaagtgtctgtgaactggacttgatctttaattttcataaggcttactatatattggatgaaattctgattgccggtgaacttcaagagtcgagtaagaagacagttgcacgcctgatagctgcacaagattctctcgtggaggcagccaaagagcaagctagttctataagcaatatgattgctcaagcgacaaaataaggagctagtagtatataaaaatgcttcttctttgaggggacaaagacttgttggaagatgcctgttagtggtaattggtgcagtaatttcaccgccttcttcttcttcgtcggcgataaccctaagcagagtgaaattctttaattgcgagttcaaaacgacagcatccatcaagaagccgcgacaaccgcttcgtctctctcttgtgaattgccgtcgaactgaaatggcgacagcatcaccatctgttggaactgcgcccaaatgggctcagaagaccatcacccttcctgcccaacgtcgaggctgccatctcatcacctccaagattttgaaggagattacgcaggatttgtcaggctttaagtgtggacttgctcattttttcctgcatcacacaagtgcttctttgactataaatgaaaactatgactcggatgtccgtgatgacacggagacatttctgaacagagtggttccggaaggagcatctgcaccatggaagcatactatggaaggtccagatgacatgccagcccacatcaagtcatctatgtttggctgctccctcacgatccccataacagatggaagactaaacatgggaacttggcagggcatctggctatgtgagcaccgagactatgatactcctcgcagtgttgtggtaaccctaaatgggatgtaatgtaacttcacctccacaaccaaaaagagctcttcttcttttgtttctatggtgtgtatacat

SEQ ID NO: 1769 - DNA, 772 bp, Phaseolus coccineus
agaaggagaaggggaaggagaaggagaaggagaaggagaaggagcgtgatcctgtgagcggaacgcgcgagcgaatcgagggaaatgatacaatttgtgctgctcattagtcgtcaagggaaggtcaggctcacaaaatggtattctccttactcgcagaaggaaagaaataaggctatccgtgagatcagtggcttggttcttacacgtgctcccaagctctgtaattttgtagaatggcggggacataaagttgtttataaaagatatgcaagtctttatttctgcatgtgtatggatgaggaagacaacgaattagaagtccttgaaataattcatcattttgtagagattcttgatcggtattttggcagtgtctgtgaactggacttgatattcaatttccacaaggcctattatatacttgatgaacttctcattgctggcgagcttcaggagtcaagcaagaaaactattgcacggttaatagctgcacaggattcattggtggagactgccaaggaggaagctagttcattaagtaatataatttcccaagccactaagtgagaaaatcccttgttccagttggcattttggggcatggtgtttcgtatgatcaaagagtggacttttcccgttaatatatattatgaccaagccccgtttttatttctgttatgctgaacattcgattttctctccttgattatgttttttttggtacaatggactagtatcaggaagacacgatcttctttgtctgaattcc

SEQ ID NO: 1770 - DNA, 993 bp, Brachypodium distachyon
aggtaaattacatacggagtagcaaacatatcggttcggctcgctcaaggctcatcacgcagcagacacgaccagatcgcccagacgccgaccgacgcctctcgctcccccgtctcccggagatcctctgcagcgacagacacctccggcctccggccgccaccccatcccccgcgtaaccagatccgcggtgacccccatcctcctcgctctccttctcggccctcggtagatctacgcgggccgcgaccatgatcaattttgtgctcctgatcagtcgccagggcaaggtgaggctcaccaagtggtactcgccctacacacagaaggagaggactaaggtcatacgggaactaagcgggctgattcttactcgagggccaaaactctgtaactttgtcgagtggagaggttacaaggttgtgtacaggaggtatgccagcctctatttctgcatgtgcattgatgccgatgacaacgagcttgaagtccttgaaatcatccatcattttgttgagatactcgaccgctattttggcagtgtatgcgagctggatttgatattcaatttccacaaggcctactatgtactggatgagattctcattgctggcgagcttcaggaatccagcaagaaaaatgttgcaagacttattgctgcacaggattctttggtagaggctgctaaagaggaagctagctccataagtaacatcattgcccaggctacgaagtaaattctgcgccatatgatccctcctgctctgctcctttgtttatggctgtgttggtaaatctgatgtaatggctcatttgctctgtccattttcctaagaaatatgactttctggagtcccagttcattcggaatgagtgatatgtaactacagtatatgtttcctttgcaactgaatttgggatcttcacagacaagctatcatgaagatttctcatcaatagttctaaagcaatgttctgtaaaagccataatca

SEQ ID NO: 1771 - DNA, 827 bp, Brassica napus
ggttattattatgtgcgaacgaacgatttattcattcattcattcattgttagacgggacgatcattcatcagcgtcgggagatctcttctgggaatcgaggataaacatgatacatttcgtgcttctagttagtcggcaaggaaaagtgaggctcaccaagtggtattcgccttatacacagaaggaaaggtctaaggtcatacgcgaactcagcggtgtcatcctcaaccgaggccccaagctctgcaatttcatcgaatggagaggatacaaggttgtctacaagaggtatgcaagcctgtatttctgcatgtgcattgatgaggcggataacgagttagaggtactggagattattcatcactatgtcgagattcttgaccgttactttggcagtgtttgtgaactcgatttgatttttaacttccacaaggcgtattatatattggatgagctgttgatcgccggtgagcttcaagagtcgagcaagaaaacagtggcgaggataatatcagctcaggatcaattggtggaggctgcgaaagaggaggctagttccataagtaacatcattgctcaggctaccaagtagtttctttctgatttgttgttaaaaaagcatcgttaatggtttaattatttgcttattttctgagaaattctattctaaatcacacttttctttgtccatgtcatgtcatgtgttttatctgtttgataagaaacatttattgatccttgtgggtttatgagtagtgattcctttgtaatgaccacatacagtacattctttgggatctaccatgattgataagaatactacca

SEQ ID NO: 1772 - DNA, 861 bp, Manihot esculenta
gttcctgttactgtgtgttccagattcactttgtccttcttattagtcgacaagggaaagtgaggttgaccaaatggtattccacatattctcaaaaggaaagaactaaggttattcgtgaactaagtggtgtgattctgtctcgaggacccaaactttgtaattttgttgaatggagaggatataaagttgtttataaaaggtatgctagtctttatttctgcatgtgcattgatcaagatgacaatgaattggaagtccttgaaataattcatcattatgttgagattctggaccggtattttggcagtgtctgtgagttggacttgatcttcaacttccataaggcttactatatattggatgagcttttgattgctggtgagcttcaagagtcgagcaagaaaacagttgccaggctaatagctgcgcaggattcactggtggaggctgcaaaagagcaggccagttccataagtaatattattgcccaggccaccaagtaagaataatgtaggtccaggcagaagctgaggtctgatgacagattatgttggatgatggtatgagaaagagtagatgaaaatgtctaatcacagaaacatgcacctaggtagcatctaaatccgatcatgtggaatagttactttattgagaaatagaagtgagatgcctatggccccagaattactgtcagtccttggtgtttgaatagaaatccatttcaactcccataaacttgtttgcttttagatggatagtctattattctcgtctttgttattgcagtttttgcttcagaagctgaggcaaatctgtaccctgccttaatggaacataaaagaaactgataaaactgca

SEQ ID NO: 1773 - DNA, 896 bp, Manihot esculenta
tgaaaaagaaaaaaaaaaggggcggtggtgtagtagctaagcagcctaagctgaagaggttttgacagagttgtgatctcttgagaaacaaacagagaatatgattcactttgtccttctcattagtcgacaagggaaagtgaggttgaccaagtggtattcgccatattcacaaaaagaaagaactaaggttattcgtgaactaagtggagtgattctgactcgagggcccaagctttgcaattttgttgaatggagaggatataaagttgtttataaaaggtatgctagtctttatttctgcatgtgcattgatcaggatgacaatgaattagaggtccttgaaataattcatcattatgttgagattttggaccggtactttggcagtgtctgtgagttggacttgatcttcaacttccataaggcctactatatattggatgagcttttgattgccggtgagcttcaagagtcaagcaagaaaacagttgccaggctaatagatgcgcaggattcactggtggagactgcaaaagagcaggccagttcaataagtaatattattgcccaggctaccaaataagactagaaagagcaattgcattttttattgattgattttaaaatggtgctgtcattagttgatgcttattgcatttttttccttttgatatgtggaatgtgtgagcttgtattttattaaactggatagttattgtgattcacctagaatctgtcaaatgtgattcatgcgattgacccttgcatcaagtgaaactgatcactaaacgctctctgaatgttgttagcggtgattgtacttaaatactgtaacaactgacttggtagaagctgcctcatttttaacgatgattgatggatcgttttttccc

SEQ ID NO: 1774 - DNA, 894 bp, Ricinus communis
aaggaggagcagcctggttctggaaaaaaagaaaaccgaaagctatttgttgtttgggttttttatttttaatttttgttgatctcttaatacaaaaccgtcaaatcaaatcaaaaacaagaagaagagaagatgattcagtttgtacttcttattagtcgacaaggaaaagtaagattgacaaaatggtattcaccttattcacaaaaggaaagaactaaggttattcgcgagctcagtggagtaattctaactcgagggcctaagctctgtaattttgttgaatggagaggatacaaagttgtttataaaaggtatgctagtctctacttctgcatgtgcatcgatcaggatgataatgaattagaagtccttgaaattatccatcattttgttgagattttggaccgatactttggcagtgtctgtgagttggatttgatcttcaacttccataaggcctactatatattggatgagctgttgattgctggtgaactccaagaatcaagcaagaaaactgttgccaggctaatagctgcacaggattcattggtggagactgcaaaagagcaggccagttcaataagtaatattattgcccaggccaccaagtaagataagaagcgatattacattttatattggttaacattgaagtgctgtgctcccaactgttgatccttattacaatttttcttctcattatgtgaaatatgtgatatgcttgtattttcaaggattatacacttgatagcttttgtgattcatctgcaaatgtatgtcaaatgtggttcatatgttttatgatcagaacatttgttaagctaaactgattgtttatctaagatgctatgtaagttctttggcagtaattgtatttaatttgctgga

SEQ ID NO: 1775 - DNA, 626 bp, Catharanthus roseus
aatcagtggagacgaagcttgaacctctggttacctttgatctccggccaaatttccggctttcatacaccgtgatctgtacggaaaaggaagcccgaaactaccgcaacaaccatgattcactttgtgcttctcattagccgacagggaaaagtaaggttgacgaagtggtattcaccttatacccagaaggaaaggaccaaggtaatccgagaactcagtggtttaattctcactcgaggccccaagctttgcaactttgttgagtggagaggatttaaggttgtttacaaaagatatgccagcctctatttttgcatgtgcatagaccaggaggacaatgaattagaggtccttgaaatcattcaccattatgtggagattttggaccgctattttggaagtgtttgtgagttggatttgatctttaactttcataaggcttattacatattggatgaactattgattgctggggagcttcaagaatctagcaagaaaacagttgcacgcgtaatagctgctcaggattccttggtggaagctgctaaagagcaagcaagttctttgagtaacatgattgcgcaggcgactaagtagtaacaacagtcattgtgaaatttttc

SEQ ID NO: 1776 - DNA, 748 bp, Centaurea maculosa
cttggcggggacggcaacgatcaaagcaattttgatattctttctctgagtagcttttttcaatcggattgaagattctctaccagcagtctgagtcatgattcattttgttctcttgataagccggcaaggaaaagttaggctgacaaagtggtattcaccttattctcagaaagaaagaagtaaggtaatacgagagctgagtgggatgattcttacgcgtggccccaagctttgcaatttcgttgagtggaggggattcaaggttgtttataaaagatacgccagcctgtacttctgtatgtgcattaaccaggaagacaatgaattggagatccttgaaattattcatcattacgttgaaattctagatcgctactttggcagtgtctgtgagctggacctgatctttaattttcacaaggcttattatatactggatgaggtactaatagccggggagcttcaggaatcaagcaagaagacggtggcccgtttagtagctgcacaggattcattggttgaggcagccaaagaagaagcaaattctataagcaatataattgcacaggcaaccaagtaaagcatatgttgttacatgataatatgtattatgttatgtgtttttcttttcttcttagtttggaatattggctttctatgtttgacaaattacttaaatgtcccttgtggatttcgtccgactatagaaactaccttcattatgaaagagatgtatttactcaaa

SEQ ID NO: 1777 - DNA, 789 bp, Centaurea maculosa
gggggttctccgggagatcaaaccaaatccaatatttttgattttctctctctctaagtggatttttcaatcagatcggagggcagacgtgaagatttctctcccagcagtttgaatcatgattcattttgttctcttgataagccggcaaggaaaagttaggctgacaaagtggtattcaccttattctcagaaagaaagaagtaaggtaatacgagagcttagtgggatgattcttacacgtggccccaagctttgcaatttcgttgagtggaggggattcaaggttgtttataaaagatatgccagcctctacttctgtatgtgcattaaccaggaagacaatgaattggagatccttgaaattattcatcattatgttgaaattctagatcgctactttggaagtgtttgtgagctggacctgatctttaattttcacaaggcttattatatactggatgaggtactaatagccggggagcttcaagaatcaagcaagaagacggtggcccgtttagtagcttcacaggattcattggttgaggcagccaaagaagaagcaaattctataagcaatataattgcacaagcaaccaagtaggcatatattgttacataaaatatgtattatgtgattttcttttcttcttagtttggaatattgcctttctatttttgataaattacttaaatgtcccttgtggatttcgtccgactatagaaactacctccattctgtaatagatgtatttacttaaattcgtgcgttggcgttggtttgtgtcg

SEQ ID NO: 1778 - DNA, 841 bp, Castanea mollissima
ggaaagaagaagaagaagaagctgaagctctttctttctttctttctttctttcaaattgatctgatctccacacaccaaaatgattcactttgtgcttcttattagtcgacaaggaaaagtgaggttgacaaaatggtattcaccatatacccagaaggaaagaactaaggttctacgggagctaagtggagtgattcttacccgcgggcccaagctctgtaattttgttgaatggagaggatataaagttgtttataaaagatatgctagtctgtatttctgcatgtgcattgaccaagaagacaatgaattagaggtccttgaaataattcatcattatgtggagattttggaccgatactttggcagtgtctgtgagctggacttgatcttcaatttccacaaggcctactatatattggatgaactattgattgctggtgaacttcaggaatctagcaagaaatcagttgcacggttgatatctgcacaggattcattggtggagatggcaaaagagcagcgcagttcaataagtaatataattgctcaggccaccaagtagaggacagtcatacatagtcccctgatatattggttgaaattcaagcgcttactgtattattcttattctgtgtttttctttgtaatgactggaatgcaccttttgtttcgtatgtgtttttgaggattgtgacatgattgcatgtctgaattacctttaaaactacatgttctatatggttgatgcatttggccggtttttgccaggtgttttgtgagtagttttctaagggtattattagcacttatgtgcaaggcaatgagccttaatagaa

SEQ ID NO: 1779 - DNA, 911 bp, Cicer arietinum
ctgaaagaatttgagatctctttatgccaaaatatcaatgatacactttgtgctcctcattagtcgtcaagggaaggtcagactcacaaaatggtattcaccttatactcagaaggaaaggagtaaggtaatccgtgagcttagtggagtgattcttagccgtgctcccaagctctgtaactttgtagagtggagaggacataaagttgtttataaaaggtatgctagtctgtatttctgtatgtgtattgatgatgaagacaacgaattggaagtccttgaaatgattcatcattttgtggagattcttgatcggtattttggcagtgtctgtgaactcgacttgatattcaacttccataaggcctattatatacttgatgaacttctaattgctggtgagcttcaggagtcgagcaaaaaaactgttgcccggttgatagctgcacaggattcattggtggagagtgctaaggaggaagccagttccttgagttatcgcacaagccactaagtgaagagattcaatgttgcaattgttgccatttttaggaatgaagaaatgtttggcgcgattaaagtgtgaacttatagtttatgtctatgttgcacctctattgttgttatgttgaatttgtaaaatagaaaagaaagaaaaaaactaagttctgacaagaatatttcatcttgatttgcattgcaattctccttagttagagggatgtggagaaactattgttgttgatgttgattctgttgcagtgcaattctcatggtaagatatttcatgtatgtatacatgtgtgacctgtatatttgtgttgtagatatattttcttgatgatgtagaggaatacttttattttgtacaatgctcagagattgaatttcagtagtgctgattaatctta

SEQ ID NO: 1780 - DNA, 858 bp, Cichorium intybus
tgtttcaccggcgacgatcaaggcaaatccaacccttaaattttctctctgagaggtttcgatcggatctgacggcagacgacgtttttcttgcagaattttgagccatgattcattttgttctattaataagccgacaaggaaaagtcaggttgacaaaatggtattcaccttatacccagaaagaaagaagtaaggtaatacgagaactcagtgggatgattctcacacgtggccctaagctttgcaattttgtcgagtggagaggatttaaagtcgtttataaaagatatgccagcctgtacttctgtatgtgcattaaccaagaagacaatgaattggaagtcctcgaaattattcatcattatgtcgagattctagatcgttatttcggaagcgtttgtgagctggatctgatcttcaattttcacaaggcttattatatactggatgaggtgctaatagccggggaacttcaggaatcaagcaagaagacggtggcccgtctagtggcagcacaggattctttagtggaggcagcaaaagaagaagcaaattctataagcaatataattgcacaggcaaccaaataagctttgtacttgtccctatgcatcttatttctctacatcagtggcggtttacctttttattggtggtgttgtttttattctcttgctgtggaaatattttaaatgtttgaaatcaggaatatgaaaagtaatctgatataaatgactggatatgtgtatctgttcattttgagctttttgatgtgtaaatttactgatttgcttcgtctaaactccaacatatccaaacttgagatgttgtatgaaaaagattatgtattaaaaa

SEQ ID NO: 1781 - DNA, 750 bp, Cichorium intybus
gcggggatttaccggtgacgaaaaaccaaatccagctctccgctttctctcttccgaagtgggatcggatcggcagacgtgaagctttactgaatacttccaaccatgattcactttgttctcttaataagccggcaaggaaaggttagactgacaaagtggtattcaccctattcccaaaaggaaagaagtaaggtgataagagagcttagtgggatgattcttacacgtggccccaagctttgcaactttgttgagtggaaaggattcaaagttgtgtataaaagatacgcgagcctctacttttgtatgtgcattaaccaggaagacaatgaattggaggttcttgaaatcattcatcattttgttgagattcttgatcggtactttggaagtgtgtgtgagctggacttaatcttcaattttcataaggcttactacatactggatgaggttttaatagctggagaacttcaggaatcaagcaagaagacagttgcccgtttagtttctgcacaggattctttagtggacaccgcgaaagaagaagcaaattctataagcaatataattgcacaggcaacaaagtgaactacactttttcactttggtaatttcaagtttgacactaaatcatttttgggggatttgagtgatttgcatattcatttgattcccttattggtgtgttgtagaaagaattttggttttgaagtgacataaatttcaaaatgagtgattgttgtcaaa

SEQ ID NO: 1782 - DNA, 840 bp, Citrus sinensis
gggggtcttattggagaataataataatattgaagaggagaagacaatacagacagcggaagtggagcagagaagaattgcataacatattaaagctgacgggtatttcatcatcaaacacaaacaatgattcactttgtgcttcttattagtcgacaaggaaaagtaaggttgacaaaatggtattctccttatacacagaaggaaagaagtaaggttattcgtgagctaagtggtgtgattcttacacgaggacctaagctctgtaattttgtggaatggagagggtacaaggttgtctataaaagatatgctagtctatacttctgcatgtgcattgatcaggaagacaatgagttagagatccttgaaataattcatcattatgttgagattcttgacagatactttggcagtgtttgtgagttggacctcatcttcaactttcacaaggcttattacatattggatgagatcttgattgctggcgaacttcaagagtccagcaagaaaacagtcgcacggctaatagctgcacaggattcactggtggagactgcaaaagagcaagctagttcaataagtaatataatcgcacaggccacaaagtaggatgtaccaagtatgttcgtgtaatatattgattgagtttgaagtgatttctgcattgaatttcctcttccagttccttttcaagaatttaataacatgttaagaatgtatttttaagaattgtgcccttgattgctcttttcatttgcttatagttatgtcatgtattttaaagccttttcctgtaaagacattgcaagaaaaccattcttaaaatttttggatgta

SEQ ID NO: 1783 - DNA, 612 bp, Trifolium pratense
ggcacgaggcttcgtttccatttctctctctctctctgcaacagcaacagcaacagcaacatcaacagcaacatcaacattcagttgagtagaattgagatctcttacgccataatcaatgatacactttgtgttgctcattagtcgtcaagggaaggtcaggctcacaaaatggtattcaccttacactcagaaggaaagaagtaaggtaatccgtgagctcagtggagtgattcttagccgtgctcccaagctctgtaactttgtagagtggagaggacataaagttgtttataaaaggtatgctagtctatatttctgtatgtgtattgatgacaccgacaacgaattggaagtccttgaaatgattcatcattttgtggagattcttgatcggtattttggcagtgtctgtgaactagacttgatattcaacttccataaggcctattatatacttgatgaacttctaattgctggtgagcttcaggagtcaagcaaaaaaactgttgcccggttgatagctgcgcaggattcattggtggaaactgcaaaggaagaagccagttccttgagtaatattattgcacaagccactaagtaaggactcca

SEQ ID NO: 1784 - DNA, 790 bp, Vigna unguiculata
gggaaggcaaaaatcgaaggtttgggagaaggagaaggagaaggagaagggagcgtgatcctagcagcggaaggcgcgagcgaatcgagggaaatgatacactttgtgctactcattagtcgtcaagggaaggtcaggctcacaaaatggtattctccttactcgcagaaggaaagaaataaggctatccgtgagatcagtggcgtggttcttacacgtgctcccaagctctgtaattttgtagaatggcggggacataaaattgtttataaaaggtatgctagtctttatttctgcatgtgtattgatgaagaggacaacgaattagaagtccttgaaataattcatcattttgtagagattcttgatcggtattttggcagtgtctgtgaactggacttgatattcaatttccacaaggcctattatatacttgatgaacttctaattgccggtgagcttcaggagtcaagcaagaaaactattgcacggttaatagctgcacaggattcattggtggagactgccaaggaggaagccagttcaataagtaatataattgcccaagccactaagtgaggaaatcccattttccatttggcattttggggcatggagccccgtttttatttctgttatgttgaatgtttgttttcctctccttgattctgtgttttttttgtgcaatagaaagggacataaaccaagtgtgttaataggaagatacgatcttctttatctgaattctaaggttggcaatttcatacatgaagttcatttttttcaggca

SEQ ID NO: 1785 - DNA, 840 bp, cucumber
ggggaagaagctttactgtgatcagagagatcgaatttttgttgaggattttggctttgagattgctggttcttgaaacttcataacaaaatgattcactttgtgcttcttataagtagacaaggaaaagtgaggttgacaaaatggtattctccatatactcagaaggagagatctaaggttatccgtgagcttagtggaatgattctaaatcgagggcctaagctttgtaactttgtggaatggaggggactgaaagctgtctataaacgatacgctagtctttacttttgcatgtgcattgatcaggaagacaatgaattagaggtccttgaaattattcatcattacgttgagattttggaccgttactttggcagtgtctgtgaattggatttgatcttcaactttcacaaggcctattacatattggatgagcttctaatcgctggcgaactccaagagtcaagcaagaaaacagtagcaagattgatagccgcacaggattcgttggtggagactgcaaaggagcaagctagttcaattagtaacataattgcacaggccaccaagtagatgaataacgtgagagtgtatgtttcagtttttgcgaaattgatttgttccgaagtattgtaattatatgttatatctcaactagtatcaaacaagttaatgccttatttttgcttatttcatttgttgtattccacaaattgctttacggaatttcaagtgattccatctacctgcctaaatgttttcctccatttttctgttgttcatcacatacaaatgttattgcttgctagaaatgcttgatctcctatacttgttttc

SEQ ID NO: 1786 - DNA, 893 bp, Taraxacum officinale
tcggcgggggaatagccaactctaaaataacaagtccctttgtatagaggtgctctgcttcaccggcgaggagcaaggcaaatccggcccgtcaattttcgctctctgagtacagttttcgatcggatctgaaggaaaacgaggtttctctcacagaggtttgagccatgattcattttgttctcttaataagccgacaaggaaaagtcaggctgacaaaatggtattcaccttatacccagaaagacagaagcaaggtaatccgagagctcagtgggatgattctctcccgtggccccaaactttgcaactttgtcgagtggagaggatttaaagtcgtgtataaaagatatgccagtctctacttctgtatgtgcattaaccaagaagacaatgaattggaagtccttgaaatcattcatcattatgtcgagattctagaccgttattttggaagcgtttgtgagctggatttgatctttaattttcacaaggcttattatatactagatgaggtgctaatagccggggagcttcaagaatcaagcaagaagaccgtggcccgcctagtggcggcacaggattctttggtggaggcagctaaagaagaggcgaattctataagcaatataattgcacaggctactaaataaggttgaatgatatatgaatcttgtttctttgagtcagtggtacggttggtttaccattttttttgtgttttttgtttagaatttgaagtctgaaaagtaaactgatgaatgtttgaatatgtgtacttgttgattttgagctcctagatgtgtaaatttacagatttgttgtttgtctaaactgtaatggtgtgatatctcaacttcaatgttatgtgaaacaaaacatatcctgaaaaa

SEQ ID NO: 1787 - DNA, 1167 bp, Eucalyptus gunnii
  misc_feature (52)..(52): n is a, c, g, or t
  misc_feature (219)..(219): n is a, c, g, or t
  misc_feature (282)..(282): n is a, c, g, or t
cggccgggggagagagacggccatggagtgacgtcaggaaaggggtacttcngcgattcctcgagacgccgatctaccgtccttagatcgtggttttgcaattcggaagagggaaccggcgatgctctgccatctcggcggcggaggaatagctccctcgctgtcagaatagctcttggcgtgaaaaagtgatcccagattcgcatttgcctgtacagnttccccgcaggggctgccgatcggccgatggtgcagagtcgcctgcaaatttgaagtactcgngttcgatctccgacccgaatcatgattcacttcgttcttctaattagtcgtcaagggaaggtcaggttaacaaaatggtactcgccatattcgcagaaggaacgaactaaggtcatccgagaaatcagtgggttaatgcttcatagaggtcctaagctgtgcaatttcgtggagtggggaggtttaaaggttgtctacaaaagatatgcgagtctctatttttgcatgtgcattgatcctgaggataatgaactagagactcttgaagtaattcatcattttgtggagattttggaccggtactttggcagcgtttgtgagctggacctcatatttaacttccataaggcctactatatcttggatgagcttgtgattgctggtgaaattctagaatccagcaagaaaacagttgcacggctgatatctgcgcaggattctcttgtggaggctgcgaaagaagaggcaagttcaataagcaacataatcgcccaagccacaaaatgatagccatcagataacagcaaattctatctttcctccaaatatgctcccaagccaccaagtcagatacaatatatgcttttgctgtgttttgtatccttttctttgtgtcagtgtgtttcctgttcattgaatttcaaggattcttcatgtaacactacagtttgtgacttcaagcaatttaagttcagttttggctttaaatgcgctgtatctgtggtaatggttctgtcacattcgatcatgccttaaacatcttcacatatgcatactgaggtttttttttgccggcaagacatatcgcaatgaaatacagtttgtatggggatgatgtttctcaatcacttgtctatgttcataaactcaagttgttttttagag

SEQ ID NO: 1788 - DNA, 684 bp, Adiantum capillus-veneris
cgatcttcgaagaggcaacgaaagatcgagccagcagtcgtctttcgcacatcgcccagcatgattcactttgtgctgctcatcagtcgccaaggcaaagttcgcctcacgaaatggtattcaccatatacacagaaagagaggcagaaggctattcgagaacttagtggcctcatactaacgaggggaccaaagctttgcaattttgttgaatggagaggtctaaaggttgtttataaacggtatgccagcctttatttctgcatgtgcatcgatccagaggataatgagttggaatgccttgaaatcattcatcactttgtcgagatccttgatcgatactttggcaatgtttgtgaattggacctgattttcaatttccacaaggcatactatattcttgacgaggttttacttgctggagaattacaagaaactagtaaaaaatctgtagctcgtgttattgcagcacaggacacgctggtggaaaatgcgaaggagcaagcgaatacattgacaaatattatagcacaagccacaaaatagcaaggtaacaggaactcacatcttttgagcatcgcattctggtggtgacaaaatgctacttctgctcttcttggaagctgagttgtgggatggggagaatggctggaaactcctgtcaagaaccaatgcggcttaaga

SEQ ID NO: 1789 - DNA, 641 bp, Festuca arundinacea
ggcacgaggaccgtccctagccatgatcaatttcgtgctcctgatcagccgccagggcaaggtgaggctcaccaagtggtactcgccttacacccagaaggagaggaccaaggtcattcgcgagcttagtggactcattcttactcgaggaccgaaactctgcaactttgtcgagtggagaggttataaggttgtgtacagaaggtatgcgagcctgtatttctgcatgtgcattgatgctgatgacaatgagctcgaggtccttgaaattatccatcattttgttgagatactcgaccgctatttcggcagtgtatgcgagctggatttgatcttcaattttcataaggcctactatgttctggatgagatccttattgctggggagcttcaggaatctagcaagaagaatgtcgcaagactaattgctgcacaggattcattggtagaggcggctaaagaggaggctagctccataagtaacatcattgcccaggctacgaagtgaaaaaaaaatctttgccttaatgtccttgcccctctgtccttttgtgtttgtttatgttggtatagcttatctgctatgttcatgttcccaaagaaacacgacttgccagattctaaagcattcagaatctgtg

SEQ ID NO: 1790 - DNA, 737 bp, Gerbera hybrid cultivar
gcgaagcaaatccagctcaattttttctctccaagcgttttcaatcggatcggctcggatcggcagacgcgaagcttctattgaaagtagtttcaaccatgattcactttgttctcttaataagccgacaaggaaaagttaggctgacaaaatggtattcaccctattcccagaaggaaagaagtaaggtgatacgagagcttagcgggatgattctcacacggggccccaagctctgcaactttgttgagtgtaggggatttaaagttgtttataaaagatatgcaagcctctacttttgtatgtgcattaaccaggaagacaatgaattggaggtccttgaaatcattcatcattttgtcgagattcttgatcgttactttggaagtgtttgtgagctggacttgatcttcaattttcataaggcttattacatactggatgagatattaatagcgggggaacttcaggaatcaagcaagaagacagttgcacgtctagtttctgcacaggactctttagtggaggcggcgaaagaagaagcaaattctataagcaatataattgcacaagcaaccaagtaaactttacttttcgctaaacgtatatgtgcattgcttatgtcttctttttgtgttttttttttgggaattaagtgatttacgtattgatttgattctgattcggctattgtagaaagagtttgacatgatctttgaaatgggtgtttcttgatt

SEQ ID NO: 1791 - DNA, 898 bp, Vitis vinifera
cctttccgtaaattcgaaaaactcctccctgaaaccaaactctagaaactcggtgctttcttcctcctgctaatctctgcgcattccgaatttgatccgcttgaagccatgattcattttgtgcttctcattagtcgacaaggaaaagtgaggttgacaaaatggtattcaccttatactcaaaaggaaagaactaaggtaattcgagagctcagtggcgtaattctgacccgaggtcccaagctttgcaacttcgtggagtggaggggatataaagttgtctacaaaagatatgcgagcctgtatttctgcatgtgcattgaccaggatgacaatgaattggaggtccttgaaataatccaccattatgttgagatactggaccgctattttggcagtgtctgtgagctggatttgatttttaatttccacaaggcttattatatattggatgagcttttgattgctggtgaacttcaagagtcaagcaagaagacagttgcacggctgatagctgcacaggattcgttggtggagactgctaaagaggaggccagttcaataagcaatataattgctcaagccaccaaataagatctgtatttaaatgagttggtctgtatactcccctggttggcagtgttcaatatgatacaatctctcattttgtttctttaattccgtattcgctcaagccatcatattttttgttgtaaaaaataaaaaattgttttctatttttaaaaacaaaatactatttttgtttctggttctcaaatacgtttttctaccgagtagtagaaaattgttcctataaacaattgtctaacatggtcttaatttcttttttattttatggaaagtgtggtcctaataagtgacacatggttttggattc

SEQ ID NO: 1792 - DNA, 797 bp, Vitis vinifera
ctcatgagtcagatactcagatccctctgactgtctctctccgtttcagcaatctcagatcatcgccataatcgtgaaccgggttggttctctcagctatcaatccaaaatttggaattgtacttaaagttatgattcactttgtgcttctcattagtcgacaaggaaaagtgaggttgacaaaatggtattcaccttattctcagaaggaaagaactaaggtaattcgagagctcagtggcgtaattctgacccgaggtcctaagctttgcaactttgtggagtggaggggatataaagttgtctacaaaaggtatgcgagcctgtatttctgcatgtgcattgaccaggatgacaatgaattggaggtccttgaaataatccaccatttcgttgagatactggaccgctattttggcagtgtctgtgagctggatttgatttttaatttccacaaggcttattatgtattggatgagcttttgattgctggtgaacttcaagagtcgagcaagaagacagttgcacggctgatagctgcacaggattcgttggtggagactgctaaagaggaggccagttcaataagcaatataattgctcaagccaccaaataagatctatatttaaatgagttggtttatacactcccttggttggcaatgttcaatatgatacaatctcttattttgtttctttaaatctgtatttgataactgatgagtgcaatattttggtattatattttaatatactcctttctgtatttcttaataagcaaaggcgattgaactcca

SEQ ID NO: 1793 - DNA, 882 bp, Ipomoea nil
  misc_feature (192)..(192): n is a, c, g, or t
  misc_feature (669)..(669): n is a, c, g, or t
ggaattacatacattttacaaaatgaaaacccgtacaacttgaatcaggaaacgggtcctttttctcgggtgcgatactgcgatttcatctcggacaagtaaaggggtcctgaaacaatagcgggagcgttgagaagtgcggtctttggtgcttctctcggccattattctgcagtcatgatccattttgtncttcttataagccggcagggaaaagtgaggctgacaaaatggtattctccatatgcccagaaggagagaactaaggtgattcgtgagctcagtggtatgattctcacccgaggcccaaagctttgcaattttgtggaatggagaggatttaaagttgtttataaaagatatgctagtctttatttctgcatgtgtattgatcaagaggacaatgaattggagatattggaaatcattcaccactatgttgagatattagacagatactttggcagtgtttgtgagctggacctaatatttaattttcacaaggcatattacatactggatgaacttttgattgctggtgaactccaagaatcaagcaagaaaactgttgcgcgtttaattgctgcacaggattctttggtagaggctgccaaagagcaggcaagttcgctaagtaacatgattgcacaagccacaaaatgagaatgnagtacagagacattttccttttatgcattatgtgatcttcatgagacattatttctcctctgatatgtttgtcgtgttcttaaaagtactagttctctttattttcaagcaatttttttttatcttttgtactctacttggttgtagcaatatacttgattttgcatattacagcatagtctgtagtcctgtgctacttgcccacttgtgtac

SEQ ID NO: 1794 - DNA, 799 bp, Jatropha curcas
attcttcgctgcagcagagattttgaattcttttgatagctcttaatagaacagacaaacaagataatataatatgattcattttgtccttcttataagtcgacaaggaaaagtgagattgacaaaatggtattcgccttattcacagaaggaaagaactaaggttgttcgtgagctcagtggggtaattctgactcgagggcccaagctttgtaattttgttgaatggaggggatataaagttgtttataaaaggtatgccagtctatatttctgcatgtgcattgatcaggacgacaatgagttagaggtcctcgaaataatccatcattttgttgagattctggaccgatactttggcagtgtgtgtgagctagacttgatcttcaacttccataaggcctattatgtactggatgagcttttgatcgctggtgagctccaagagtcaagcaagaaaacagttgccaggctaatagctgcacaggattcattggtggagactgcaaaagagcaggccagttccataagtaatattattgcacaggccaccaagtaagatatgaaagagcaattgtattttgtgttcattgactttgaggtgctctgctgccaattgttgatgttcattataattttttcttttgatctgtgaaatatatgttatgcatgtattttactatattagatagcatttgtgattcacctaaaactttatgtcaaatgtgattcatattccttatattagggcttttatcaactgaggctgattacaacttaaatgcattgtgaaagtgtg

SEQ ID NO: 1795 - DNA, 914 bp, Lactuca sativa
tgttcaacaaaatagaagtccctttgtatagaggtgctctgttccaccggcgacaatcaaggcaaatccaacccttcaattttctctcttcgagattttctctcttttagtttgggcaagttttgtaataaatgcgaggttatttcatcttcttcagtagagttttcgatcggatctgacggcaaacgaggtttttctcgcagaagtttgaaccatgattcattttgttttgttaataagccgacaaggaaaagtcaggttgacaaaatggtattcaccttatacccagaaagaaagaagtaaggtaatacgagagctgagtgggatgattctcacacgtggtcccaagctttgcaactttgttgagtggagaggatttaaagtcgtttataaacgatatgccagtctctacttctgtatgtgcatcaaccaggaagacaatgaattggaagtccttgaaattattcatcattatgttgagattctagatcgctatttcggaagtgtttgtgagctggacctgatctttaattttcacaaggcttattatatactggatgaggtgctaatagcaggagagcttcaggaatcgagcaagaagacggtggcccgtttagtggcggcacaggattctttggtggaggctgctaaagaagaagcaaattctataagcaatataattgcacaggcaaccaaataaagcttctacttgctcttacctctatcatattgatatattcacatctatctttttctgttgttttttcccttttgtttgtgtggaaatcttttttttaagtgttagaattttgaattttgaaaagtcaactgatgttaatcaaatgtatggatgtgtgtatttgttcattttgagcttctagatgtgtaacaacgatatatcttaactgcaaaaa

SEQ ID NO: 1796 - DNA, 709 bp, Liriodendron tulipifera
cagagagagagagattccggtactatgattcactttgttcttcttatcagtcggcagggaaaagtgaggttgacaaaatggtattctccttatacgcagaaggaaagatccaaggtaatccgagagctcagtggagtgattctcacccggggcccaaagctctgtaatttcgtcgagtggaggggatacaaagttgtatataaaagatatgccagcctctacttttgtatgtgcattgacgaggatgacaatgaactggaggtccttgaaattattcaccatttcgttgagatactagaccgttatttcggcagcgtctgtgagttggatttgatcttcaattttcacaaggcatactacatactagatgagctcctgattgctggtgaacttcaagaatcaagcaagaaaactgtggcacgactcatagccgcgcaggactcgttggtggagactgcgaaagaggaggctagttctataagcaatatcattgcacaggccacaaaatagtgtatgttgaaatttagtctttggttctatgggtttgtcatgttgtttgtattagttcttgacctcccttgcatgaatggatgggcgcatgaattttaatttttaatttttaaattttttttttttttgagattgataacgtctccgatgatttgtctcatccatcatcatcattcttgttttcgtcatggccttgtcc

SEQ ID NO: 1797 - DNA, 1418 bp, Zea mays
acgactcactttcctgaccccgaccccgacccgtttgccttcctgaatcctgtcgccgtctcgcgtgccttcattcccggcggcgacctcttcgtggggcctttcgccggcaacgagcacccacgcaccaggattcagatcgtgctacgacggctcctgtccatccaccatgattaatttcgtgcctgatcagccgccagggcaaggtgaggctcaccaagtggtattctccgtacacccagaaggagaggaccaaggtcattcgcgagctcagtggactcgttcttacacgagggcccaaactctgcaactttgtcgagtggaggggttacaaggttgtataccggaggtatgctagcctgtatttctgcatgcgcattgatgctgatgacaatgagcttgaagtccttgagatcatccatcatttcgtcgagatactggaccgatattttggcagtgtatgtgagctggatttgatattcaatttccataaggcctactacatactggatgagattctcattgccggtgaacttcaagaatctagcaagaagaatgttgcaagacttattgccacacaggattcgttagtggaggctgctaaagaggaagccagctccataagtaacatcattgctcaagccacaaaataaagttcttcaccagtctaatgcccgacatcttgtcgttgttgttcaagcaactgtaatgcactggactgctagtccatttgctctgctcatgttttctgtggaatacgggtttcaagacttagaaagagcgtgatgtgtaaattccttgatgttgtaggtgtgtgcagagccttatgttggagcacaagcatgggattgattcgttctattctttttcttcccttgagctttaccttgcactgctgctagtctttacaccttacactatcgagagatcggttctggaagtttgcttacactgctaggctctacaccatggaaaagattggtacgtcttgccgggcttagcaatgagctgctcctgttaacaatggctgttatataggttgaggatggaggaggacattgggagaacaaaccctgtagcactccgtgcaggtagagtcgccgtctaaagcactagatgccagctgttcagccgcacggacacggaggagggacatggaggagacaaggttggtgcacgcgaattctggaagcaatggcggacaaggaatcctgttttccgctccaattgcaacgaatcttgttttctatccatagattagatatccgtaccctgcttcgctatttctctccaccccttagggcatgtacaaccttaagactttgatttgattttcaaaatacaagagacaactaagaaaatgtatggtccaacctgagactctagataatacataataaatgcagctaagagaatat

SEQ ID NO: 1798 - DNA, 937 bp, Zea mays
gcaatttttcagttccaatgtatagttttaaattttcgaatatttttaagcaaagatgaaaagccactctcctccctggtggagtcgaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaagctgctaaagaggaagccagctccataagtaacattattgctcaggctacaaaatgaagttcttcatgcctgccccccttccctctatcttgttattgttgtacaagcaactgtaatgcactggactgcgagttcatttgctctgctcatgtttatggatttcaagactccaggttatttagaatgagcgtgatgtgtaactacattgcatgtgttcccgttgcaagtaaaatcatgacctcgttgattgtc

SEQ ID NO: 1799 - DNA, 3529 bp, Zea mays
aaacgagaaggccctcctgcctgccccttgcttcctcccgagtcccgtggcggcggcggcggctgctcgacccgcccgcccggccgccatgtcgatctgcgggtaccactccccacgcttctccgagaattgtgcgtttgtcgggcacccttcgcaggagcatcaggattgtcagaacgccactgatggttatagcggcttcatcttgcacttgtcaggagatgaggacacggtggttagttcaccggtcagcagcaatgtgctacctttctctttgcgtgtgtcttcagaaagtgccgcacaaccttccctagctgaaggcagtggcaatcctcagataccaaactctggtacgtgcaatggtctatccgagagcctctgtgcagatggtgaagaacaagaggtcaatgctgtctcccagaatcagtttgaggctaacgatcctcaggttgatatgccgacaaaagtggctcgcaaggagatcagtatacaacctgatacaatcagacatagaagacatggtttcaatggtggaaaggttgatgttcgaaagcttcgtaatgttgatgtaaatgatgcgattgaactatcgattgctgcatctgaggccatggttattgcagagatgatacttgatgattctcagcctgataaatcggctgcagctgctatagaagctgctctacacgtgaaagaagcccggaagcaattctactttgaggagccacaacatgcttgtggatcctcagaaggtggtcttgatgagattgattggcttgcagaattggatgagtctgaaatggttgacgcataccaagatgttgctctgtccctcatccacattgcttgctcatctcaagatcataacacaggtgatttgaagcaacaaaattcccatcctacttgtcccccatgtgatgcagacacacacatcttatgggattcttcttctgagaggcaaaataaaaaatggaacagccaaaatgctgatagtgatgaccatgtatctgattcttttccaaacaatcagtcagcaggagttgctgcacagacgaatgttggtatgaagaagcgtgtaaaaggtttgtttgaggaagaaaatagctacatttctgattcaattagcacagataggcgctgtcctacttctagagcatcatccatggaaattgtcgcctcttcaagggcatctttgtattgcaaagctgaaggtttacttgaagaaaatcatcatcctggaactgaagagttgtgttgccaagtagtatgttctagcttgtcacaagtggatcctttatgttccattgttccatgtagcatatcttgcgatgaaggtcccagtagccaggctcctgtgtgcaaacagagtgaaggccatgaaggtcccagtaaccaggctccttcgtgcaaaaagaacgaaggcaatgaaggtcccacttgcctgacacctgaacgcgaacatagtaaaaaaaaggaggaagaatttatgcataccaaagaatttcctatgatgcaatacctggatgaggaggctggtccatcttgtgtgcctttagttaagccagcagattctaatgttccattccggcgaaggaaatacagttcactaaggccatttagcacaatagcaactaagtcaaacatatttggaagtacatcaaattctaatgctgatgttccagtttgtcagcttgagagattcacacccattgttctaaataagaatgtacagcgtgtgcaagctgccaaggaattcatagaaaatagtgctggggctgaaaatttggaagatttctctgcagttcggaagcagacatattatcctcaggatggcagtgaggatcaaatcagggagctacaggtcccacgggaagtctttccgccaacagagaatttggttgttaaacagcaccttaaaagaaaaagggtccaattttcagaagcaaagcgtagtagcagaagaaccaagaacaatagaaggatcctgactaaatcaagattcagtcgatcagatagcagaacaggagagatgcttgagaccagagagtacactgataacaaagaagacacatttcaaggagtagagtttctgttgactggatttcctaaacagaaggaaaaagaaattgagtccctaatacgaaaatctggtggctatgtactttctaaagtgtcaccctttccacttgataaaagaaagaacatggctgagtttccaagctggaatcctcccatagtactttcgcctaaaaaggtgtcaacagctaagttcttatatggctgtgctatagatgcctggatattgaatcccatttggctcttcgattctcttcaagccggcatcatgctgccacctggaaagtatttaattcgacaaaggaatgcccagaagcataattcatcattcgaccgcccacttcacccaaaatgtaatacattgatatttgatggagtaggattcttgatccacggcaaaatcagcttctgttcaaaattttccaacattgtcaagcttgtttccttgtctaatatcatttttttttctcacagcatggagggggccaagtttttatatctcttcagggattagttcaaagcttgaaggatggaagtacatcgcgtggaatcattcttattgcaaacgcggctagtgcgtctcgtcatctaacccattgtggtttggagcatgacataaatacagcgaggagaacctcattttcatgtagaaacataacccttttttttctcttggtgccagatacattttgtgctcctcatcagcaggcaggggaaggtgaggctgacgaaatggtacactccatacccacagaagcagagatccaagatcatcaaagagattagtacgctcgtcctgacaagaggccccaagctgtgcaattttgtcgactggcaaggttacagagttgtgtacaagaggtatgctagcctttacttctgcatgtgcattgaccccgctgacaatgaactggaaacccttcagatcatccatcactatgttgagatattggaccgctactttggcaatgtctgtgagcttgatctgatattcaattttcataaggcgtactttatattggacgaaattttgattgctggtgagcttcaagaatcaaacaagaaatcggtgctacgtctagtaactacacaggacgctttggtggaagccgcaaaggaggaggcaggctcgttgaggaacataattgcacaggctaccaagtagagcactcgtgtcttctacaatgattactcacacccccacggcatgatagtagcttaatcactaccttacggggcagcagcttttacccctgatttttcctcaatagtttatcccctcttccatctctgcattttgttcagaggtctgttctgttctgtcactctctctctctctatctctcttgttttcgcactgtaccacctgtttcgagggaatgtgttgtttctgctcttttgcatgcacaacgttgtatacggaataaaataatgcaatgttttggttcccagt

SEQ ID NO: 1800 - DNA, 968 bp, Medicago truncatula
gacagaccaagctcttcatcttctcttctgatttcaactaaattctcattctcattcgtaaatcgtaacaattcaattcaacaaaaaacattcagaatcgaatcgagtgaatttagatctctttcgccaaaatcaaaatcaatgatacactttgtgcttctcattagtcgtcaagggaaggttaggctcacaaaatggtattcaccttacactcagaaggaaagaagtaaggtaatccgtgagctcagtggagtgattcttagccgtgctcccaagctctgtaattttgtagagtggagaggacataaagttgtttataaaagatatgctagtctatatttctgtatgtgtattgatgatgctgacaacgaattggaagtacttgaaatgattcatcattttgtggagattcttgatcggtattttggcagtgtctgtgaactggacttgatattcaacttccataaggcctattatatacttgatgaaattctaattgccggcgagcttcaggagtcgagcaaaaaaactgttgctcggttgatagctgcacaggattcattggtggagactgctaaggaggaagccagttccttgagtaatattatcgcacaagctactaaataaggagatccagtgttgcaattgctattatatatttgtactggccatcaagtaaagatatccgctgttgtaattgttggcattttgaggaatggagaaatgtttggtacgattgaagtgtgaacttagtttatttctatgctccatgtttattgttgttaagttgaatttgtaaaatagaaaagaaagacaacatttctggtgtatacatgtgttgcaattcatcttgatatgcgttgcaattctatggatggctatttcaagcttctatacatgtgtgacctgattattattatttgtgttgatctatttgcttgaagatcaggaatactttcattttgtac

SEQ ID NO: 1801 - DNA, 840 bp, Cucumis melo
agaagaagctttactgtgatcagagagatcgaattttttttgttgaggattttggctttgagaccgctggttcttgggagttcataacaaaatgattcactttgtgcttcttataagtagacaaggaaaagtgaggttgacaaaatggtattctccatattctcagaaggagagatctaaggttatccgtgagctcagtggaatgattctaaatcgagggcctaagctttgtaactttgtggaatggaggggactgaaagctgtctataaacgatatgctagtctttacttttgcatgtgcatcgatcaggatgacaatgaactagaggtccttgaaattattcatcattacgttgagattttggaccgttacttcggcagtgtctgcgaattggatttgatcttcaactttcacaaggcctattatatattggatgagcttctaattgctggtgaactccaagaatcaagcaagaaaacagtagcaagattgatagccgcacaggattcgttggtggagactgcaaaggagcaagctagttcaattagtaacataattgcacaggccaccaagtagatgaataacttgagagtgtatgtttcagtttttgcgaaattgatttgttctgaagtattgtaattatatgttatctcaacttgtatcaaacaagttaatgccttatttttgcttatttcatttgttgtattccacaaattgctttttggaatttctagtagttccatctacctgcctaactgttctcctcgatttttctattgttcatcatatacaaatgttattgcttgctggaaatggttgatctcctatacttgctttcg

SEQ ID NO: 1802 - DNA, 943 bp, Pennisetum glaucum
atccgctggccccgttgcttctgtaggtcgcggcgatttccccccgatagagatctcccgttcaccgccctctctctcacgcccacgctcgtggcttcattcctgtcggcgccgccctcctcgtcgagcccttcgccggcgacgagcatctaccaggatccagagcgtgctacgacctctcctgcccatccgccatgattaatttcgtgctcctgatcagccgccagggcaaggttaggctcaccaagtggtattcaccatacacccagaaggagaggaccaaggtgattcgtgagctcagtggactcattcttacgcgagggcccaaactctgcaactttgtcgagtggagaggttataaggtcgtatacaggaggtatgccagcctgtatttctgcatgtgcattgatgctgatgacaatgagctcgaagtccttgaaatcatccatcattttgtggagatactggaccgctattttggcagtgtatgtgaactggatttgatattcaacttccacaaggcctactacatactggatgagattctcatagctggtgagcttcaagaatctagcaaaaagaatgttgcaaggcttattgcggcacaggattcgctagttgaggctgccaaagaggaagccagctccataagtaacatcattgctcaggccacaaaataaattctacaccaatctaaagcctccccctttgctccatcgtgtctttgtacttgtacaagtaactgtaatgcaccggactgctctgtccatgtgttctgttcatttttcacaaggaatacagtgttcaagactgcagatcatttagaatgagggtggcatacgactacattgtatgtgtacctttgcaagtaaatttggcatatttcagatttctgaggcatagttgtaaattcattattttacaagtggtttacgttttcttc

SEQ ID NO: 1803 - DNA, 773 bp, Pennisetum glaucum
gggtggccatgtggtcccattttcgcggcccacatgcatagactgcggggttgcccacaaaccgttcgtcaaggcctcaactcctctcgttccgggcgggcgcgatcggcttctgcggcgccggcgatcaccgtcgacgactcctcggaagtagcgttgattcttcttcggagcagaacaagagccccaaccgacgccgaatcatgatacatttttgtgctttctcatcagtaggcagggaaggtgaggctgacaaaatggtacgctccatacccacagaagcaaagatccaaggtaatcagagaaataagtgcgctcgtactgacgagaggccccaagctgtgcaattttgttgactggcaaggttacagagtcgtgtacaagaggtatgctagcctttacttctgcatgtgcattgatcctgctgacaatgaactggaaactcttcaaatcatccatcactatgttgagatattggaccggtactttggcaatgtctgtgagctagacctgatattcaatttccataaggcttactttatattggatgaggttttgattgccggtgaactccaagaatcgaacaagaaagcagttctgcgcctagtaactacacaggacgctttggtggaagccgcaaaggaggaggcaagctcattgagcaacataattgcacaggctaccaagtagagcacttatgtcttgtacaatcattacccacagcctcagagcatgatggtaacttaatcagtaccatacagcaacagctttca

SEQ ID NO: 1804 - DNA, 858 bp, Mimulus guttatus
gcaaaaaaggaaacgtcacggttgtgaattcggatcagcgccgagacagaaactccgccggccaacgccgccgccatgattcattttgttcttctcattagcagacaagggaaagtaaggttgacaaaatggtattcaccttatacgcagaaggaaagaaccaaggttattcgggagcttagtggcatgattctcactcgtggccccaagctgtgtaattttgtggagtggaggggatacaaagttgtttacaaaaggtatgctagcctttatttctgcatgtgtattgaccaggatgataatgaattggaggtccttgaaattatccaccacttcgtcgagatactcgaccgctactttggaagtgtctgtgaactggatttgatctttaacttccataaggcctattacatattggatgaaattctgattgctggggaacttcaggagtcgagtaagaaaaccgttgcacgtctagtagctgcccaggactcacttgtggaggcggccaaggaagaagcaagttctataagtaatatcattgctcaggcgacaaaatgagaatttatttagtggtataaaaatgtggttagtacatttggttgatctttaattcaatgttttttatcacaaatttgaggttgacctcattattattattaccccagtcaattttttttacctagtatgtgaagtggttgctaattaaaatctttgtattattaatgctgctgttgtgtaatggttgctacatttatctgccgttgactttctacgccaggtccaagttgacgcttctctaattcttcttgtggatattggttaatgcctacaaattattacaagggctacaattgt

SEQ ID NO: 1805 - DNA, 825 bp, Nuphar advena
gtccctccgacttccgatcgaaaatgattcactttgtgcttctgataagccgacaaggcaaggtgaggttgacaaaatggtattcaccttatgcgcagaaggagaggtctaaggtgatccgagagctcagtggattgattcttacccgaggcccaaagctctgtaactttgttgaatggagaggatacaaagttgtctataaaagatatgctagcctttacttctgcatgtgcgtagatcaggatgccaatgaactggaaatactcgaaataatacatcattttgttgagatacttgatcgctatttcggcagtgtttgtgaattagacctaatcttcaatttccacaaggcatacttcatcctggatgagcttttgattgctggtgaacttcaagagccgagcaagaagactgttgcaagacttatagctgcacaggattctttggtggaaagtgctaaagagcaggctaattctttaagcaatataattgcacaagcaacaaaatagaggtgccgcatgacctgcattaatacagctttgtgtaatttctagtgttcttgtgtcttgggtatttctagatcattaaaagatgcagttgttgtgtacttaagagactactgcaggctgggagaggtcatctccagtatctgaagatgcaagcataaatattcttatggggcttttgattccttttttttctctttcaactttgtattttcaagaatgtatatttggctttgattttctttgaattttttatcatcctgtctgaattttcactttaggctgggcaaaaactaaaaacaaatttcttttttttttt

SEQ ID NO: 1806 - DNA, 893 bp, Quercus alba
acgaccgtaaatgaaatttgcattatcggagtctcggagaaggaaagaggaagaagctgctgaagctgaagctctttctttctttctttctttctaattgatctgatctccacacaccaaaatgattcactttgtgcttcttattagtcgacaaggaaaagtgaggttgacaaaatggtattcaccgtatactcagaaggaaagaactaaggttctacgggagctaagtggagtgattcttacccgagggcccaagctctgtaattttgttgaatggagaggatataaagttgtttataaaagatatgctagtctgtatttctgcatgtgcattgaccaagaagacaatgaattagaggtccttgaaataattcatcattatgtggagattttggaccgatactttggcagtgtctgtgagctggacttgatcttcaatttccacaaggcctactatatattggatgaactattgattgctggtgaacttcaggaatctagcaagaaatcagttgcacggttgatatctgcacaggattcattggtggagatggcaaaagagcagcgcagttcaataagtaatataattgctcaggccaccaagtagaggacagacatacatagttgcctgatatattggttgaaattcaagcgcttaatgtattattcttattctgtgtttttctttgtaatgacttgaatgcaccttttgtttcgtatgtgtttttgaggattgtgacatgattgcacgtctgaattaccattaaaattacatgttctatatggttgatgcatttggccggtttttgccaggtgttttgcgagtagttttttaagggtattattagcacttatgtgcaaggcaatgagccttaatgatgcatttccatttt

SEQ ID NO: 1807 - DNA, 924 bp, Carica papaya
atttttacgcgcgtcactctttaccgtctcccttctcctcatctcctccctgggctctctcaaatcagtgaagattgtggaagagcatcggctccaattggtgaaaaggattagtgttcgaataaaagatgattcactttgtgcttcttataagtcgccagggaaaagtgagactaacaaaatggtattcaccctattctcaaaaagagcgatcaaagattattcgagaactaagtggggttattcttactcgagggccaaaactttgtaattttgtggaatggagaggatacaaagttgtttataaaagatatgctagtctgtacttctgcatgtgcatagatcaggacgacaacgaactggagatccttgagataattcatcattttgttgagattcttgatcgctatttcggcagtgtctgtgaattagacttgatttttaactttcacaaggcctattatatattggatgagatcttgattgccggtgagcttcaagagtcaagtaagaaaactgttgcacggctaatagctgcacaggattccttggtggagactgcaaaagagcaagccagttccattagtaatataattacacaggccacaaaatagccaaactgtaagcataggtttcctgttgtaattcactttaaactgcaatctgtttcgactttcctccctcagaatccacctgaagagctgaatgtaagcagatttgaattgttggattatatagtcgattgattgtctggtttctttacagttttaaccgatgtataaatttgtacttctcaaggggacacgttaaattttttggaaaaacttttctgttactcggataggatgtaatattcatgagacttggggatctcatcccttgagcagtttcagtttcactatatgaattgatttggttcttgaa

SEQ ID NO: 1808 - DNA, 805 bp, Arachis hypogaea
gtcttattacgatctgctgtgcagcattcagaattgagatctctttgaccacgatccaatgatacactttgtgctgctcattagccgtcaagggaaggtcagactgacaaaatggtattcaccttacactcagaaggaaagaagtaaggtaatccgtgagctcagtggagtgatccttacccgtgcacccaagctatgtaattttgtagaatggagaggatataaagttgtatacaaaaggtatgctagtctgtatttttgcatgtgtattgatgaagatgacaatgaattagaagttcttgaaataattcatcattacgtggagattcttgatcggtattttggcagtgtctgtgaactagacttgatattcaacttccacaaggcctattatatactcgatgaacttctaattgccggcgaacttcaagagtcaagcaagaaaaccgttgcccgattgatagctgcacaggattcattggtggagactgcaaaggaggaagctagttcaataagcaacataattgcacaagccaccaaatgagagagatctaatgttacactttcttcatgctcgtatgtctatctctatgtatcgattatattcgtgttattggtgaatttgttttactttcgagcttctagacccgagttgctggtcttgtggtggcaatttcaagttagtgcaagtgtgatctacctattattgggagttaccccctttgttcgaggaatagtagacttttactgtatattgttttgagattgaaattatattgattgttcagaaaagaaaagtcgaggg

SEQ ID NO: 1809 - DNA, 885 bp, Capsicum annuum
atcggacatgcatgatacaattttcagctcaatccaacaaaaacaaaaagtacaattcctaataattgcactaatcttcaactatcatcggaatagttgttgagcctcgacacaaaatccccacaactcgaatttcacctttgcagaaggaggtgtttgttctttggatcagccgccatgattcattttgtgctgctcattagccgacagggaaaagtgaggctaaccaagtggtattcaccatatacacaaaaagagagaaccaaggtaatccgtgaactaagtggtatgattctcactcgaggaccaaagctttgcaattttgttgagtggagaggatacaaagttgtttataaaagatacgcgagcttgtatttttgtatgtgcatagaccaagaggacaatgagttggaggtcctggaaatcatacaccattttgttgagattctggaccgatactttggaagcgtctgtgagctggacttaatcttcaattttcacaaggcgtactatatattggacgagcttgttatagctggtgaactccaagaatcaagcaagaaaactgttgcacgtcttattgctgcacaggattctttggtcgaggctgccaaagaggaggcaagttctcttagtaacatcattgcacaggccactaaatgagggggtatccaggtgttcaagttttttcgagtgcatttaagtttttcatattgttcgttgctgtaatccgatcttgttatgacattattcgtttaaattcgtagttaaatagtttggaatttcttgatagtaatgagttttcttctcaactaagatgtaatagccgtttcttcctgcacttattagtcgtaattttttgaattttttctgtttaagcggccg

SEQ ID NO: 1810 - DNA, 761 bp, Petunia hybrida
aaaagcccccgttaactttcattgtccttctctcaggcaacatcagcacaaggaaggagcttgttcattggatcaacaatcatgattcactttgtgctgctcatcagccgacaagggaaagtgaggctaaccaagtggtattcaccatatgcacaaaaagagagaaccaaggtaatccgtgaactcagtggtatgattctcactcgaggaccaaagctttgcaattttgttgagtggagaggatacaaagttgtttataaaagatatgcaagcctgtatttctgtatgtgcatcgaccaggaggacaacgagttggaggtcctggaaatcatacaccattatgttgagattctggaccgatacttcggaagtgtctgtgagctggacttaatctttaattttcacaaggcatactatatattggatgaacttctgattgctggtgaactgcaagaatcaagcaagaaaactgttgcacgtctaattgctgcgcaggattctttggtcgaggctgccaaagaggaggcaagctctattagtaacattattgcacaggccaccaaatgagagtatgaagacatttttgagcgcatttaaaagttcttttgattctcgctgctgtagtccattcttgttatgactttacgtctcctttcatgcattttgtatcatggttttcacttaacttctttgtagacaaaaaaggatgttttatagtagtgattttttttctcaatgatgcgtgttgctacaatgatgta

SEQ ID NO: 1811 - DNA, 1274 bp, Pinus taeda
atttcgttctcaaccgtcaaccccgggatccgcttttagtgtttcccaaaccttacattgctgttggagttaccttcgcttcgctcagctgtataccttgcctgcgacagtgtgagctcccgttcttggtctttcggttcacctttcgtcttccgcagcggcacgcccacgtacagatctctgcgagtgacaggcatggacttctgagaatatctcaaccttacagaaagtgaacttgcattctagctcattgcattgtggatacccttgtattgagagcggaggatctttgtgacgatgattcactttgtgcttctgatcagccggcagggcaaagtgagattgacaaagtggtactctccttattcacagaaggaacgttcgaagataatccgtgaaattagcggagtgatacttacaagaggtccaaagctctgcaatttcattgaatggagaggtttcaaagttgtatacaaaaggtatgccagtttgtatttctgcatgtgcattgatgcagatgataatgagctggaggtccttgagataattcatcattttgtcgagatacttgatcgatactttgggagtgtttgtgagttagatctcatcttcaattttcataaggcctattatatattagatgaacttctgattgccggggagctccaagagtcaagtaagaagacggttgcacgtgtcatagctgcacaggattctcttgtggagagtgcaaaagaacaggctagttctttgagcaatatcattgctcaagcaaccaaatagaaccatgttgtcaaatattcttagaaccttttatgccgtggtttttatatgattttttttttttttttgtttgcgcctagcctgttttttctcatacaatctggcagctcttacctttaaagctgtgaacaattcattggatcacggttgtacctttaagaattgtgagtatctatgaagttctcatatatcctggcatatcttgtacaatctggtaggtctcatctctaatgttcttaataatacattgaaggacagagttattccattaggcatcccaaattattagttatttgggctctcaggcaatagccagtttgaattagtttgattaggtctctgtattttactgcaatgagtctgtattctgtgacttgtctacaatttctctgttaatactttttcctcttagtgtgatttgaagcattgctacagcttatggcattattattattaattttatgacttagatcaccaagaagagacacaaa

SEQ ID NO: 1812 - DNA, 895 bp, Pinus taeda
  misc_feature (877)..(877): n is a, c, g, or t
ttacgaagtttttctcttctcttcattctttccataatattcttatatttttttttgatcgtctggcccttccgatctataacaggaagtgaaggatttgacattgaaactgacgatttcgttttaatggcgtctgcataaagttttctcacccggcaatagagtttttcagtctgccatattcggtttggcattgaattctttgagatctctgcgagtgacaggcgtggacttctgagaatatctcaaccttagagaaagtgaacttgcattctagctcattgcattgtggatacccctgtattgagagcggaggatctttgtgacgatgattcactttgtgcttctaatcagccggcagggcaaagtgagattgacaaagtggtactctccttattcacagaaggaacgttccaagataatccgtgaaattagcggagtgatacttacaagaggtccaaagctctgcaatttcattgaatggagaggtttcaaagttgtatacaaaaggtatgccagtttgtatttctgcatgtgcattgatgcagatgataatgagctggaggtccttgagataattcatcattttgtcgagatacttgatcgatactttgggagtgtttgtgagttagatctcatcttcaattttcataaggcctattatatattagatgaacttctaattgccggggagctccaagagtcaagtaagaagacggttgcacgtgtcatagctgcacaggattctcttgtggagagtgcaaaagaacaggctagttctttgagcaatatcattgctcaagcaaccaaatagaaccatgttgtcaaatattcttagaaccttttatgccgtggtttttatatgattttttttttntttttgtttgcgcctagc

SEQ ID NO: 1813 - DNA, 896 bp, Populus trichocarpa
agtttgataacatacccacagctcccttccttttccttctccgtcttcgcccagatcatcagaaactttcaacgtaaaagcaagcaagcaaagagcgacaactctaattacaagtagacccatctgctgaatccagctcaatcctctctgcttttctcagtttgtggagattatcgattcggggtcgttcaccaaatcggtcaacacaaacaaaatgattcaatttgtacttctcattagtcgacaaggaaaagtgagattgacaaaatggtattcaccttatacacaaaaggaaagaagtaaggtaatccgtgagctcagtggagtaattttgactcgaggacccaagctttgtaattttgttgaatggagaggacagaaagttgtttataaaagatatgctagcctttacttctgcatgtgcactgatcaggacgacaatgaattagaggtcctcgaaataattcaccattttgttgagattttggaccgatactttggcagtgtctgcgagttggacttgatcttcaacttccataaggcctattatgtattggatgagattttgatagctggtgaacttcaagagtccagcaagaaaacagttgctaggctaatagctgcccaggactcattggtagagactgcaaaagagcaggccagttcgataagcaatatcattgcccaggccacgaagtagaatacaagattggttaagctttgaatagtgttgttccatttgtattgaattttattcctgagatctgaaatgtatgttatggatgctttcttgaggattgtacgctgaactatatgttaaatgtctcatatgtttcccaattgaggtctgatccactgtagatgactagctaaaagtcccgagagtgttacagcca

SEQ ID NO: 1814 - DNA, 738 bp, Papaver somniferum
gggatttggcgatctctttctgtaacacctgcacattcattaccttagatcggaaaccatgatacactttgtgctccttatcagtcgacaaggaaaagtgaggttgacaaaatggtattcaccatattcccagaaggaaagaactaaggtgattagagagcttagtggagtgattcttacacgaggtcctaagctctgtaattttgtagagtggagagggtacaaagttgtatataaaagatatgccagcctttacttctgcatgtgcattgatgaggatgacaacgaactagaggtccttgaaataatacatcattttgttgagatactggatcgctactttggcagtgtatgtgagttggatttgatcttcaatttccataaggcatactatatcttggatgagcttttgattgccggggaactgcaagaaaccagcaagaaaacagttgcacgacttattgcagcacaggattcattggtggagactgcaaaggagcaggctggtataatcagtaatattattgcccaggccacaaaatagtcttcccaagtttggtctttgtttatagaatataacggatcttttgcaaccttctgtactattttaatcttttctgacggtttttttacttttactttctcattttaagcaatcctttgtatcatctgagtgttggttgttgtcaaactggtgggagctataattagaagtaaaacatgaggtgcttatttttc

SEQ ID NO: 1815 - DNA, 893 bp, Solanum tuberosum
aaaaaataaaagacagtacagaaaatacagtatagaaataataggaacacaaaatcccccaactccaatttcacctcgcaagaagaagaagaagaaggaggagttgtttgtaccttggatcaccagccatgattcattttgttctgctcattagccgacagggaaaggtgaggctaaccaagtggtattcaccatatacacaaaaagagagaaccaaggtaatccgtgaactaagtggtatgattctcagtcgaggaccaaagctttgcaattttgttgagtggagaggatacaaagtcgtttataaaagatacgcaagcttgtatttctgtatgtgtatagaccaagaggacaatgagttggaggtcctggaaatcatacaccattttgttgagattctggaccgatactttggaagtgtctgtgagctggacttgatcttcaattttcacaaggcatactatatattggacgaacttgtgattgctggtgaactccaagaatcaagcaagaaaacagttgcacgtctaattgctgcacaggattctttggttgaggctgccaaagaagaggcaagttctcttagtaacattattgcacaggctactaaatgagagtatggaggcggcgttcaagttttttgagtgcatttatgtttttcagattctcgtttgttgctgtaatccaatcgtgttatgacattatttcttctttcaatgctattgcatcatggttttcgtttaactttgtagttaaaaataggaatttctttgtagtaatgagttttcttctcaacctaagcgtgtgtttactgcagtgatgtatgtactctgttgcctaaaaactggtggtaatatatatagtacttgttcctaggtggagctagctgataa

SEQ ID NO: 1816 - DNA, 845 bp, Pseudoroegneria spicata
gacccagaccgcccagcccagacgccgacccacgccgctcgcactcccgtctctcggcgatcctcccttctccgacgacaggcttccaccccgtccgccctcgccgccagatccgcgcggccacgcccaccctcccccgctcttcctctcgggcctcggcagatctacgcgggcggcgaccgtccctagccatgattaattttgtgctcctaatcagccgccagggcaaggtgaggctcaccaagtggtactcgccttacacccagaaggagaggactaaggtcatccgtgagcttagtgggctcattcttactcgagggccaaaactctgcaactttgtcgagtggagaggttacaaggttgtgtacagaaggtatgcaagcctctatttctgcatgtgtaccgatgctgatgacaatgagcttgaagtccttgaaattatccatcattttgttgagatactcgaccgctatttcggcagtgtgtgcgagctggatttgatattcaatttccacaaggcctactacgtactggatgagatactcatttctggtgagcttcaggagtctagcaagaagaacgttgcaagacttattgctgcacaggattcgttggtagaggctgctaaagaggaagctggctccatcagtaacatcattgcccaggctacgaagtaaaagtttgcatctgatgattcccctcctccctttggtttatgtttatgttggtaaatttgatgtaatagctcctttgctgtatccattttcccaaagaaatatgacttcctggattcggacctgttcagaatgagtgatatttaactacaatgcatgtgttcttttgca

SEQ ID NO: 1817 - DNA, 831 bp, Raphanus sativus
ggatggatccgacccgaaatgcattccacttagaataaccttaaatgacaattatatccccatagcactcgacctgtttgaacagagaacagaggaccggaccggatcggatcattcatcagcgtcttcgtctttcgctgtcatccgtcttcgaattacgaaatcatgatacatttcgtgcttctagttagccgccaaggaaaagttaggctcaccaaatggtactcgccttacactcagaaggaaagatctaaggttatacgtgagctcagtggagtgattctgaatcgaggtccaaagctctgcaatttcgtcgagtggagaggctacaaagtcgtctacaaaagatacgcgagcctctacttctgtatgtgtattgatgcggaggataacgagctagaggtccttgagatcattcaccactacgttgagattctcgaccgctatttcggaagtgtgtgtgaactcgatttgatttttaacttccacaaggcgtattacatattggatgaacttttgattgccggcgagctccaggagtcaagcaagaaaacagttgccaggattatatctgctcaggatcaaatggtggaagcggcaaaagaggaagctggttccataagcaatatcatcgctcaggctactaaatagtttctttcactcttctacttgcgtcttccatacatgtgttcctgcgcccctggctgctaagttaaatgttctgacaatcttttttttttttaaatctcctaatgactgaagaagtgtgaatatgctataagttattttattttatttaataaatttatatttttttttataaatttaaca

SEQ ID NO: 1818 - DNA, 811 bp, Raphanus sativus
acgatcattcattgttggaggatcaatcaaatcatcagcttcgggagatctcctctgggaatcgaggatctgtggagttacgtgataatcatgatacattttgtgcttctagttagtcgacaaggaaaagtaaggctcaccaagtggtattcgccttacacacagaaggaaaggtctaaggtcatacgcgaactcagcggtgtaatcctgaacagaggtcccaagctctgcaatttcatcgaatggagaggatacaaggttgtctacaaaaggtacgcaagcctgtacttctgcatgtgcattgatgagacggataacgagttagaggtactggagatcattcatcactacgtcgaaattcttgaccgttactttggcagtgtgtgtgaactggatttgatttttaacttccacaaggcgtattatatattggatgagctgttgatcgccggtgagcttcaagagtcgagcaagaaaacagtggcgaggataatatcagctcaggatcaattggtggaggctgctaaagaggaggctagttccataagtaacatcattgctcaggctaccaagtagtttttttctgatttgttgttaaaaagcattcgttaatggtttaatatttccttattttctgataaattctattctaaatcacacttttcctttccatgttatgtcatgtgttttgtctgtttgataagaagaaagaaacatttattgatcggtgtgggtttatgagtagtgattcctttgtaaagacaacatacagcacattctttgccatctaccatgattgataagagtacta

SEQ ID NO: 1819 - DNA, 847 bp, Raphanus sativus
  misc_feature (168)..(168): n is a, c, g, or t
  misc_feature (785)..(785): n is a, c, g, or t
  misc_feature (821)..(821): n is a, c, g, or t
ggatacccctcacattcaggtcgtttctattattacgataattcattgttggaggatcaatcaaatcatcagcttcgggagatctcttctgggaatcgaggatctgttgagttatctgtggtcatcatgatacattttgtgcttctggttagtcgacagggaaaagtnaggctcaccaagtggtattcgccttacacacagaaggaaaggtctaaggtcatacgcgaactcagcggtgtaatcctgaacagaggtcccaagctctgcaatttcatcgaatggagaggatacaaggttgtctacaaaaggtacgcaagcctgtacttctgcatgtgcattgatgaggcggataacgagttagaggtactggagatcattcaccactatgtcgagattcttgaccgttactttggcagtgtgtgtgaactggatttgatttttaacttccacaaggcgtattatatattggatgagctgttgatcgccggtgagcttcaagagtcgagcaagaaaacagtggcgaggataatatcagctcaggatcaattggtggaggctgctaaagaggaggctagttccataagtaacatcattgctcaggctaccaagtagtttctttctgatttgttgttaaaaagcattcgttaatggtttaatatttccttattttctgagaaattctattctaaatcacacttttcttttccatgttatgtcatgtgttttgtctgtttgataagaagaaagaaacatttattgatcggtgtgggtttatgagtagtgantcctttgtaaagacaacatacagcacattctttgcnatctaccatgattgataagagtacta

SEQ ID NO: 1820 - DNA, 801 bp, Raphanus sativus
acattcaggtcgtttctattattacgataattcattgttggaggatcaatcaaatcatcagcttcgggagatctcttctgggaatcgaggatctgttgagttacggataatcatgatacattttgtgcttctagttagtcgacaaggaaaagtaaggctaaccaagtggtattcgccttacacacagaaggaaaggtctaaggtcatacgcgaactcagcggtgtaatccttaacagaggtcccaagctctgtaatttcatcgaatggagaggatacaaggttgtctacaaaaggtatgcaagcctgtacttctgcatgtgcattgatgaggcggataacgagctagaggtgctggagatcattcatcactatgtcgagattcttgaccgttactttggcagtgtgtgtgaactcgatttgatttttaacttccacaaggcgtattatatactggatgagctgttgatcgccggtgaacttcaagagtcgagcaagaaaacagtggcgaggataatatcagctcaggatcaattggtggaggctgctaaagaggaggctagttccataagtaacatcattgctcaggctaccaagtagtttctttctgatttgttgttaaaaagcattcgttaatggtttaatatttccttattttctgagaaattctattctaaatcacacttttcttttccatgttatgtcatgtgttttgtctgtttgataagaagaaagaaacatttattgatcggtgtgggttttatgagtagtgattcctttgtaaagacaacatacagcacatt

SEQ ID NO: 1821 - DNA, 1098 bp, Oryza sativa
atttggactccgattccacgccgacgtcgccgcctgatcgtctccggcgccggcgatcccaaccgccgcaaccaccgcctctccctcctcctcctcctccggtaggtgctcgcggccgctcgacggccacgcacgtgctcgtgtctcgctgtcccgtccgccgcctcttctccactcccccacgcttccgctccagatctgcctctccgcccgcccggatctagccaccggttcgccggcgccgccgctcgggagctgaaccgtgtggccgagtggcgacctctcctaccgcgtagccatgatcaatttcgtgctcctgatcagccgccagggcaaggtgaggcttaccaagtggtactcgccttacacccagaaggagaggactaaggttatccgtgagctcagtgggctcattctaacacgcgggccaaaactctgcaactttgttgagtggaagggttacaaggttgtgtacagaaggtatgcgagcctgtatttctgcatgtgcattgatgctgaggacaatgagctcgaggtccttgaaattatccatcacttcgttgaagtactggaccgatattttggcagcgtatgcgagctggatttgatattcaatttccacaaggcctactacatacttgatgaaattctcatcgctggtgagcttcaagaatctagcaagaaaaatgttgcaagactaattgctgcacaggattcattggtagaggcagctaaagaggaagctagctctataagcaacatcattgcccaggctacaaaataaaattctactccagtctgatgtttgctctcttttgttgtgttatattggtaaatgcaatgtactagtccatttggtctgttcagttttctaagatacgtctttcaaggtgccaggattaagaatgaacatgatgtaactacactgtatccgctattttgaaccgaagtcggattttctaagagaaaatgtgcatgagagttgatcatggagagtgcattatcttgagcagttgtgattattccacttattgttcgccttctgtattgcaatgcgtgtaaacatcagttatctaacgttcctgatagctttatatt

SEQ ID NO: 1822 - DNA, 872 bp, Secale cereale
  misc_feature (265)..(265): n is a, c, g, or t
  misc_feature (302)..(302): n is a, c, g, or t
accggtttggcaggctcaacactggtagcagatcgcgcacccgacgcgacccagaccgcccagcccagacgccgaccgacgccgctcgcactccccgtctctcggcgatcctcccttctccgacgaccggctgccaccccgtccgccctcgccgccagatccgcgcgggcacgcccaccctcacccgctcttcctctcgggcctcggcagatctaggcgggcggcgacggtccctagccatgattaatttcgtgctcctaatcanccgccagggcaaggtgaggctcaccaagtggtactcnccttacacccagaaggagaggactaaggtcatccgtgagcttagcgggctcattcttactcgagggccaaaactctgcaactttgtcgagtggagaggttacaaggttgtgtacagaaggtatgccagcctctatttctgcatgtgtatcgatgctgatgacaatgagctcgaagtccttgaaattatccatcattttgttgagatactggaccgctatttcggcagtgtatgtgagctggatttgatattcaatttccacaaggcctactacgtactggatgagattctcatttctggtgagcttcaggaatctagcaagaagaatgttgcaagacttattgctgcacaggattcgttggtagaggctgctaaagaggaagctggttccatcagcaacatcattgcccaggctacgaagtaaaagtctgtgtctgatgatgcccctctgctctttggtttatgtttatgttggtaaatttgatgtaatagctcctttgctgtatccattttcccaaagaaatacgacttcgtggattcagacctgttcagaatgagtgatatgtaacta

SEQ ID NO: 1823 - DNA, 749 bp, Carthamus tinctorius
tgcttggcgggggaaagacttctggtattctctctctctctctctctgagtagcttttttcaatcggatcggaggtcagacgtgaagatttctctcccagcagtctgagtcatgattcattttgttctcttgataagccggcaaggaaaagttaggctgacaaagtggtattcgccttattctcagaaagagagaagtaaggtaatacgagagcttagtgggatgattcttacgcgtggccccaagctttgcaatttcgttgagtggaggggattcaaggttgtttataaaagatatgccagcctgtacttctgtatgtgcattaaccaggaagacaatgaattggaggtccttgaaattattcatcattatgttgaaattctagatcgctactttggaagtgtttgtgagctggacctgatctttaattttcacaaggcttactatatactggatgaggtactaatagccggggagcttcaggaatcaagcaagaagacggtggctcgtttagtagcttcgcaggattcattggttgaggcagccaaagaagaagcaaattctataagcaatataattgcacaggcaaccaagtaagcatgcataataatatgtattatgtgttcttcttttcttcttagtttggaatattggctttctatttttgataaattacttaaatgtcctttgtggatttcatccgactatagaaactaccttcattctgaaagagatgtatttactcaaaa

SEQ ID NO: 1824 - DNA, 901 bp, Solanum phureja
agaaaacacaaactagtaaagaaaaaataaaagactgtacagaaaatacagtatagaaataataggaacacaaaatcccccaactccaatttcacctcgcaagaagaagaagaagaaggaggagttgtttgtaccttggatcaccagccatgattcattttgttctgctcattagccgacagggaaaggtgaggctaaccaagtggtattcaccatatacacaaaaagagagaaccaaggtaatccgtgaactaagtggtatgattctcagtcgaggaccaaagctttgcaattttgttgagtggagaggatacaaagtcgtttataaaagatacgcaagcttgtatttctgtatgtgcatagaccaagaggacaatgagttggaggtcctggaaatcatacaccattttgttgagattctggaccgatactttggaagtgtctgtgagctggacttgatcttcaattttcacaaggcatactatatattggacgaacttgtgattgctggtgaactccaagaatcgagcaagaaaacagttgcacgtctaattgctgcacaggattctttggttgaggctgccaaagaagaggcaagttctcttagtaacattattgcacaggctactaaatgagagtatggaggcggcattcaagttttttgagtgcatttatgtttttcagattctcgtttgttgctgtaatccaatcgtgttatgacattatttcttctttcaatgctattgcatcatggttttcgtttaactttgtagttaaaaataggaatttctttgtagtaatgagttttcttctcaacctaagcgtgtgtttactgcatctgttgcctaaaaactggtggtaatatatatagtacttgttcctggtggagctagctgataac

SEQ ID NO: 1825 - DNA, 3716 bp, Sorghum bicolor
gcccggccgccatgtcgatctgcggataccactccccgcgcttctccgaggatattgcttggctccctcaatggcttcagccgtatggcacgccgacggttggcgaccaccggaacaccactaccgccgtttcatcaccttcttgccagaattgtgcgtttgtcggacacccttcgcaggagcgtcaggattgtcagaatgccactggtggttatagcggcttcatattgcacttgtcaggagatgaggacacggttgcaagttcaccagtcagcagcaatgtactacctttctctttgcgtttgtcttccgaaagtgctgcacaaccgtccctgcctgaaggtagtggtaatcctcagatgccaaactctggtacatgcaaaggtccatccaagggcctttgtgcagatggtcaagaacaagaggtcaatgctgtctcccagaatcagttcgaggctaacaatcctcaagctgagatgctcacagtgacagaagtggcttgcaaggagatcagtaaacaacttgatacaaacagacacaaaaggcatgatgtctatggtggaaaggttgatgttcgaaaactccgtaatgctgatgtaaatgatgcgattgaactatctattgctgcatctgaggccatggttattgcagagatgatacttgattctcagtctgataaatcggctgcagctgctatagaagctgctctacatgtgaaagaagcccggaaacaattttactttgaggagccagaacatgcttgtggatcctcagaagatggtcttgatgagactgattggcttgcagaattggatgagtctgaaatggttgacgtataccaagatgttggtctgtctcttgtccgtattgcttgttcaactcaagatcagaacccaggtgatttgaagcaacaaaattctcatcctagttgtcccccatgtgatgcagacatacacatcttatgggattcttcttctgagaggcaaaataaaaaatggaatagccaaaatgctgatagtgatgaccatgtatctgattcgttcccaaataatcagtcagcaggtgtgctaccaaatgaaccaactccgtgctctgattctgtaaagcaagcagctctatgtaaaacaatttcatgctcaagaaataagaaaactgtcctccaggcgtcaactcaaaataatgctgctttgcatggaaccttgggagctctagcaacataccaaaatgttcataaggaagttgcaggagttgctgcacagacgaatgtttgcataaagaagcatgtaaaaggtttgtttgaggaagaaaatagctacatttctgagtcaattagcatggataagtgctgtcctacttctagagcatcatccatggaaattgtcgcctcttcaagggcatctgtttattacaatgctgaaggtctccttgaagaaaatcatcatgcagaaactgaagagttgtgttgccaagtagtatgttcgagcttgtcacaggtggatcctttatgttccgttgttccatgcagcatatcttgcgatgaaggtcccagtagccaggcagtctgcaagcagagtgaaggccatgaaggtccgagtagccaggctcctttgtgcaaaaagagtgaatgcaatgaaggtcccacttgtctgacacctgaacgcggacatagtaaaggagaggagaaagaatttatacataccaaagaatttcctatgatgcaatacctggatggggatgctggtccatcttgtgtgtctttagttaagccaacagattctaatatttcattcaggcgaagaaaatacagttcactaaggccttttagcacagtagcaactaagtcaaacatattggcaagcacttcaaattgtaatgctgatgttccagtttgtcagctggagagattcacacccattattctaaataagaatgtacagcgtgtccaagctgctaagaaattcatacaatatagtgccggagctgaaaatttgcaagatttctctgcagttcagaagcagacatattatcctcaggatgacagtgaggatcaaatcagggagctacaggtcccacgggatgtctttccatcaactgagaatttggttggtaaacagcaccttaaaagaaaaagggtccaattttcagaagcaaatcatagtagcagaagaaccaagatcaatagaaggatcttgaataaatcaagattcagtcgatcagatagcagaacaggacagacacttgaggcaagagagtacactgataataaagaagccacatttcaaggagtagagtttctgttgactggctttcctaatcagaaggaaaaagaaattgagtccctaatacgaaaatctggtggctatgtactttctaaagtgccacccttcccacttgataaaagaaagagcatggctgagtttccaagctggaagcctcccatagtactttcccctaaaaaggtgtcaacagctaagttcttatatggctgtgctattgatgcctggatattgaatcccaattggctcttcgattctcttcaagctggtgtcatgctgccacctggaaagtatttaattcgacaaaggaatgcccggaagcataattcgtcatttgaccgcccacttcacccaaaatgtaacacattgatatttgatggagtaggattcttcatccatggcaaaatcagcttctgttcaaaattttccaacattgtcaagcttgttcccttgtctaatatcatttttttttccacagcatggaggtggccaagtttttatatctcttcatggattagttcagagcttgaaggatggaagtacatcgcatggaattattcttgttgcaagcgcagctagtgcatctcgtcatctaagctattgtggtttggagcatgacataaagacagcgaggagaacctcattttcatgtagaaacataaccctttttttgctttggtgtcagatacattttgtgctcctcatcagcaggcaggggaaggtgaggctgacgaaatggtacactccatacccacaaaagcagagatccaagatcatcaaagagataagtacgctcgtcctgacaagaggccccaagctgtgcaattttgttgactggcaaggttacagagttgtgtacaagaggtatgctagcctttacttctgcatgtgcattgaccctgctgacaatgaactggaaacccttcaaatcatccatcactatgttgagatattggaccggtactttggcaacgtctgtgagcttgatctgatattcaattttcataaggcgtacttcatattggacgagattttgattgctggtgaacttcaagaatcaaacaagaaatcggtgctacgtctagtaactacacaggacgctttggtggaagccgcaaaggaggaggcaggctcattgaggaacataattgcacaggctaccaagtagagcacttgtgtcttctacaatcattactcacacccccacggcatgatagtaacttaatcactaccatacggcagcagctttcacccttaatttttttcattactgttccatctctgcattttgttcagagatctgttctgtcctgtccttttctttccctcttttttttttcgcactgcaccaccggtttcgagggaatgtgctgtttcagcacttttgcacaacgttgtatatggaaatggaataaaataatgcaatatatgttttggttc

SEQ ID NO: 1826 - DNA, 1086 bp, Sorghum bicolor
cctctcgcgtgccttcattcccggcggccacggtgagctaacggcggcgacctcttcgtagggcccttcgccgccggtaaacgagcacccagcaggatccagatcgtgctacggcggctcctgtccatccgccatgattaacttcgtgctcctgatcagccgccagggtaaggtgaggctcaccaagtggtattctccgtacacccagaaggagaggaccaaggttattcgcgagctcagtggactcattcttacacgagggcccaaactctgcaactttgtcgagtggaggggttacaaggttgtataccggaggtatgctagcctgtatttctgcatgtgcattgatgctgatgacaatgagcttgaagtccttgagatcatccatcatttcgtcgagatactggaccgctattttggcagtgtatgtgaactggatttgatattcaatttccataaggcctactacatactggatgagattctcatcgcgggtgaacttcaagaatctagcaagaagaatgttgcaagacttattgctgcacaggattcattagtcgaggctgctaaagaggaagccagctccataagtaacatcattgcacaggctacaaaataaagttcaccactcaaatgcctgcccctttgctctgttttgtcgttatacaagcaattgtaatgtactggactgctagtccattttctctgctcatgtttcctatggaatacggatttgaagactccaggtcatttagaatgagcgtgatgtgtaactacatagtatgtgttccgttggaagtaaagtcgtgattttcaggatttgcccagggatagttgtaaattcctggagttgtaagtgcatattttttcattgatcgtttatagtgttatctaatgtctgaaaaccactgcaagttgtgatgcgttattcaacaaattcattcatgctttgtagcgcctgtgtttagtaggtcagaaacttgggtggctatactatatttgtaagcttctgtgcatgtaaacagattccagtcttccgggattgattggtgctggcttttcactgtagtgaattctggtagtgtc

SEQ ID NO: 1827 - DNA, 594 bp, Glycine max
tttttgttcgtgttgtgtttgctttgaagaagtgaggggtgttctttgttggtgaatacacccactcacgcgttcgtggttgcaggctctaatcagatcccaaatgatcaactttgtgcttctcattagtcgccaagggaaggtgagactgacaaaatggtattcaccttactctcagaaagaaagaagtaaggtaatccgtgagctcagtggagtgattcttacccgtgctcccaagctctgtaattttgtagaatggcgaggacataaagttgtttataaaaggtatgctagtctttatttctgcatgtgtattgatgaagatgacaacgaattagaagtccttgaaataattcatcattttgtggagattcttgatcggtattttggcagtgtctgtgaactggacttgatattcaacttccacaaggcctattatatacttgatgaaattctaattgccggtgagcttcaggagtccagcaagaaaactgttgctcggttgatagctgcacaggattcgttggtggagaatgcgaaggaagaagtcagttcattaagtaatataattgcacaagccactaagtgaggaaa

SEQ ID NO: 1828 - DNA, 798 bp, Glycine max
gatcgtgttgttgtgtttgctttggagaaacgagttggtgttctttgttggcgaatactcactcacgcgtttgtagttgcaggctctaatcagatcccaaatgatcaactttgtgcttctcattagtcgccaagggaaggtgagattgacaaaatggtactcaccttattctcagaaagaaaggagtaaggtaatccgtgagctcagtggaatgattctttcccgtgcgcccaagcaatgtaattttgtggaatggcgaggacataaagttgtttataaaaggtatgctagtctctatttctgcatgtgcattgatcaagatgacaatgaattagaagtccttgaaatgattcatcattttgtggagattcttgaccggtattttggcagtgtctgtgaactggacttaatattcaactttcacaaggcctactatatactagatgaaattctaattgccggtgagcttcaagagtccagcaagaaaacagttgcccgattgatagcagcacaggattcgttggtggagaatgcaaaggaagaagccagttcgtttagtaatataattgcacaagccactaagtgaggagaacaaatgttaccgtttcctgctcatatagaatctcgaattgttgatgtcccattttactgttatagttgtatttcttgatgttgtctttctcatatcatgtttgtgtattcctgaactgtattacttgttgtggtgacattgagcccggagggttacttttactttgtatgttgttttgagattgaaattgaatagattgcttgtta

SEQ ID NO: 1829 - DNA, 1116 bp, Picea glauca
  misc_feature (1109)..(1109): n is a, c, g, or t
  misc_feature (1111)..(1111): n is a, c, g, or t
acattcaaacattcaacacaaaacgaatgatatagagttcttcttaagcgtcagatccatcagtcgtgccactccattctgccagaggaagaactgcatagtctacggatttctcagatctctgggagtaagaggcaaggacttctgcggatatcttaatcttacagaaagcgagcttgcattccatctcattgcattgtggatacctgtgtattgagagaggaagatctttgtgactatgattcactttgtgcttctaatcagccggcagggcaaagtgagattgacaaagtggtactctccttattcacaaaaggaacgttccaagataatccgtgaaattagtggagtgattcttaccagaggtccaaagctctgcaatttcattgagtggagaggtttcaaagttgtatacaaaaggtatgccagtttgtatttctgcatgtgcattgatgcagaggataatgagctggaggtccttgagataattcaccactatgtcgagattcttgaccgctactttgggagtgtttgtgagttagatctcatcttcaattttcataaggcctattatatattagatgaaattttgattgctggagagctccaagagtcaagtaagaagacagttgcacgtgtcattgctgcacaggattctctagtggagagtgcaaaagaacaggctagttctttgagcaatatcattgctcaggcaaccaaatagaactatgtagtcaaatatccttaaatccttttatggggtggtttttatatgaaattcttatctagtctggtttgtctcatacaatctggcagctcttatctctaaagttattaacattggatcacagttgtacctttaggaattgcgagtttttatgaaattcttatatatcctggcatatcttgtataatctcgtaggtctcatctctaatgttcttaacaatacattgaagtacagagttattccattaggtatcacaatttgttagttatttgggttttcaggcaatagccagtttgaattagtttgattaggtttctacgcattttactgcaatgtgtcctgtattttctgatttctttataatgtccctgttaatacttncnaaaaa

SEQ ID NO: 1830 - DNA, 883 bp, Saccharum officinarum
accgttcgcctccctctcgcgtgacttcattcccggcggcgacggtgggcgagcggcggcgacctcgggcccttcgccggcgacgagcacccaccaggatcccgatcgtgctacgacagctcctatccatcagccatgattaatttcgtgctcttgatcagccgccagggcaaggtgaggcttaccaagtggtattctccgtacacccagaaggagaggaccaaggttattcgcgaactcagtggactcattcttacacgagggcccaaactatgcaactttgttgagtggagaggttacaaggtcgtataccggaggtatgccagcctgtatttctgcatgtgcattgatgctgatgacaatgagcttgaagtccttgaaatcatccatcatttcgtcgagatactggaccgctattttggcagtgtatgtgaactggatttgatattcaatttccataaggcctactacatactggatgagattctcatcgctggtgaacttcaagaatctagcaagaaaaatgttgcaagacttattgctgcacaggattcgttagtcgaggctgctaaagaggaagccagctccataagtaacatcattgctcaggctacaaaataaagttcttcacgactctagtgcctgcccctttgttctatcttctcattgttattatacagcaactgtaatgcactggactgacagtccatttgctctgctcatgttttctatggaatacggatttgaagactccaggtcatttagaatgagcgtgatgtgtaactacattgtatgtgttccgttgcaagtaaagtcacgattttcaggatttgctcaggcatagttgtaaattcctgatgttacaagtgcatattttttctca

SEQ ID NO: 1831 - DNA, 986 bp, Saccharum officinarum
  misc_feature (167)..(167): n is a, c, g, or t
tcgaccgagctagatctccacgactcactttcgcaaccgttcgcctccctctcgcgtgacttcattcccggcggcgacggtgggcgagcggcggcgacctcgggcccttcgccggcgacgagcacccaccaggatcccgatcgtgctacgacggctcctatccatcngccatgattaatttcgtgctcttgatcagccgccagggcaaggtgaggctcaccaagtggtattctccgtacacccagaaggagaggaccaaggttattcgtgaactcagtggactcattcttacacgagggcccaaactatgcaactttgttgagtggagaggttacaaggtcgtataccggaggtatgccagcctgtatttctgcatgtgcattgatgctgatgacaatgagcttgaagtccttgaaattatccatcatttcgtcgagatactggaccgctattttggcagtgtatgtgaactggatttgatattcaatttccataaggcctactacatactggatgagattctcatcgctggtgaacttcaagaatctagcaagaagaatgttgcaagacttattgctgcacaggattcgttagtcgaggctgctaaagaggaagccagctccataagtaacatcattgctcaggctacaaaataaagttcttcacgactctagtgcctgcccctttgttctatcttctcattggtattatacagcaactgtaatgcactggactgacagtccatttgctctgctcatgttttctatggaatacggatttgaagactccaaggatttagatgagcgcgatgtgaactacaatgatgtgtcccgtgcagggaaggcacgattctaagattaaaaaaacaataaggggcgccggtttatgggtcaagcttaagaacgcgggatggccaggcattacttttttaggggccccaaatcattcagggccggggtttaaacggggggcggaaaacctggggt

SEQ ID NO: 1832 - DNA, 836 bp, Helianthus annuus
cttcggcgggggataagcaatcgaattcgctctacaactacaagagatttcgatcagatcggaaggcgaacgtgaagtttttgtctctgaagccatgattcattttgtgctattaataagccggcaaggaaaagttagattgacaaagtggtattcaccttattctcagaaagagagaagtaaggtgatacgcgagctcagtgggatgattctaacacgcggccctaagctctgcaattttgttgagtggagaggatttaaagttgtttataaaagatatgccagcctgtacttctgtatgtgcattaaccaggatgacaatgaattggaagtccttgaaattatccatcactatgttgagattctagatcgttactttggaagcgtttgtgagctggacttgatattcaactttcacaaggcttattatatattggatgaggtattaatagctggggaacttcaagaatcaagcaaaaagacagtggcccgtctagtagctgctcaggattctttggtggaggcagccaaagaagaagcagcttctataagcaatatcattgcacaggcaaccaagtaaggttgtgcttactcctacccttattcggatgcccatctctctgatcttttgagttgctgtatgtgtatgtattgtgtgttgtttttttccttctcctttttagtgtggaaatcttgggtttttatttctgatattgcacttgtgattctgtccagttacatgactacctgtgttagaactaaagagagatctatctgtttaacgaccgtatcttatgtgtacatcggtattattttcttccagaaactaaagttat

SEQ ID NO: 1833 - DNA, 869 bp, Helianthus annuus
  misc_feature (363)..(363): n is a, c, g, or t
  misc_feature (378)..(378): n is a, c, g, or t
  misc_feature (546)..(546): n is a, c, g, or t
cggcggggggagtgaagtaacttcaagtctttagacaagccagagagagcgtttactctgtttcaccggcgacgatcagagcaattcgaattctctctacaagagctatcagtcagatcggaaggtggacgtgaagttgttttgtttttgctcaagtctgactgagccatgattcatttcgttctcttaataagccgacaaggaaaagttaggttaaccaagtggtattcgccttattctcagaaagaaagaagtaaggtaatacgggaactcagcgggacgattctttcacgcggcccgaagctttgcaattttgtcgaatggaggggatttaaagttgtttataaaagatacgcgagcctntacttctgtatgtgnattaaccaagaagacaatgaattggaagtccttgaaatcattcatcactatgttgagattctagatcgttactttggcagcgtttgtgagctggacctgatcttcaattttcacaaggcttattatatactggacgaggtactgatagcgggggaacttcaggaatcnagcaagaagactgtggcccgtctagtagccacacaggactctttggtggaggcagccaaagaagaagcaaattctataagcaatatcattgcgcaggcaaccaaataatcttgtgcttaccctgcgccaatccaaacatatacatgtattttgtgctatctttttcctagtgttggttttttgttgatgacggttcaattaaaaatcacactttgtgatttcatccaattacagtttcaaccctgtttcagaagaaccaaatggatatttaattcatgtataaatctcgtacattgctattactttcattctttcaaaaaaaa

SEQ ID NO: 1834 - DNA, 812 bp, Helianthus annuus
aattcgctctacactacaagagatttcgatcagatcggaagccgaacgtgaagtgtttgtctctgaagccatgattcattttgtgctattaataagccggcaaggaaaagttagattgacaaagtggtattcaccttattctcagaaagagagaagtaaggtgatacgcgagctcagtgggatgattctaacacgcggccctaagctttgcaattttgttgagtggagaggatttaaagttgtgtataaaagatatgccagcctgtacttctgtatgtgcattaaccaggatgacaatgaattggaagtccttgaaattatccatcactatgttgagattctagatcgttactttggaagcgtttgtgagctggacttgatattcaactttcacaaggcttattatatattggatgaggtattaatagctggggaacttcaagaatcaagcaaaaagacagtggcccgtctagtagcttctcaggattctttggtggaggcagccaaagaagaagcagcttctataagcaatatcattgcacaggcaaccaaataggttgtgcttactcctaccctcattcggatgcctatctctctgattatttgagttgcagtatgtgtatgtatggtgtgttgttttattcttctttttagtgtgaaaatcttgtgtttttatttctgcacttgagattctgtccggttacatgactacctgcgttagaactaaatagggatttgtgtttaatgaccatattcatgtgtacatcgatcggtattattttcttctagaaactagttatttaatagattcc

SEQ ID NO: 1835 - DNA, 1124 bp, Panicum virgatum
ccacgcgtccgtaagtcattaccttaccagaaaagctaagaaaaaaaaagaaaatagagaaaactggcactgagctactagtctgctcgtatccgcaggcccgttgcttccccgctggtgcggtggccgatctagatcgccccccgtagatctccgttcaccgccccaacgtctctccctctcccgtggcttcattccgggcggcgccgccctctccgtcgggtccttcgccggcgaatagcacccaccaggatccagagcgtgctacgacctctcctacccgtccgccatgattaatttcgtgctcctgatcagccgccagggcaaggtgaggctcaccaagtggtattcgccttacacccaaaaggagaggaccaaggtcattcgtgagctcagtggactcattcttacgcgaggacccaaactctgcaactttgtcgaatggagaggttacaaggtcgtatacaggaggtatgccagcctgtatttctgcatgtgcattgatgctgatgacaatgagctcgaagtcctcgagatcatccatcatttcgtcgagatactggaccgctatttcggcagcgtatgtgaactggatttgatattcaattttcacaaggcctactacatactggatgagattcttatcgctggcgagcttcaagaatctagcaagaaaaatgttgcaagacttattgctgcacaggattcattagtcgaggctgcgaaagaggaagccagctccataagtaacatcattgctcaagctacaaaataaaattctacaccactctaatgccggcccctttactctatcctgtcgtttttgtacaagtaaatgtaatgcactggactgttctgtccatttgctctgtttgtttttttctaaggaatacatctctcaagactccatatcatttagaatgagcgtgatgtgtgactacattgtatgtgttcctttgcaagtaaaattggcatgttcctgactgctcacgcatagttgtaaattcatattttactagaaaatattttttcttgatctcagattgtttatgttgttttgcaatgtctgaaaacctgtgagagttgtgtttgaggaaagaaaaacagtgcgagttatcagcatt

SEQ ID NO: 1836 - DNA, 1021 bp, Panicum virgatum
ccgttgtttccccgctggtggggtggccgatctagatcgcccccacagatctccgctcaccgccaccacttctctccctctctcgtggcgtcattccgggcgccgccgccctcttcgtcggacccttcgccggcgacgagcatccaccaggatccagagcgtgctacgacgtctcctacccatccgccatgattaatttcgtgctcctgatcagccgccagggcaaggtgaggctcaccaagtggtattcgccttacacccaaaaggagaggaccaaggtcattcgtgagctcagtggactcattattacgcgagggcccaaactctgcaactttgtcgagtggagaggttacaaggtcgtatacaggaggtatgccagtctgtatttctgcatgtgcattgatgctgatgacaatgagctcgaagtcctcgagatcatccatcatttcgttgagatactggaccgctattttggcagtgtatgtgaactggatttgatattcaattttcacaaggcctactacatactggatgagattcttatcgctggcgagcttcaagaatctagcaagaagaatgttgcaaggcttattgctgcacaggactcattagttgaggctgcgaaagaggaagccagctccataagtaacatcattgctcaagttacaaaataaaattctacaccactctaatgtgtgcccctttactctatcctgtcgttgttgtacaagtaaatgtaatgcactggactgttccgtccatttgctctgttcattttttttccaaaggaatacgtctctcaagactccagatcatttagaatgagcgtgatgtgtgactacattgtatgtgttcctttgcaagtaaaattggcatgttcctgactgctcacacatagttgtaaattcttattttactagcaaattactctcttgatctcatagattgtttatgttgttttgcaatgtctgaaaacctgtgagagttgtgttggaggaaagaaacagtgcgagttatcagc

SEQ ID NO: 1837 - DNA, 825 bp, Panicum virgatum
aaattaaaccacttcgtgaaggcctcaactcctctcgtcccgggcgcgatcgtctcttccggcggcggcgatcaccgtcgactactcctcagcgccagcattcaatcctgctcagagaaggataagagtccgaccgacgccgaaccatgatacattttgtgcttctcatcagcaggcaggggaaggtgaggctgacaaaatggtatactccatatccacagaaacagagatccaaggtaatcaaagaaataagttcactcgtactgacgagaggcccgaagctgtgcaattttgttgactggcaaggttacagagttgtgtacaagagatacgctagcctttacttctgcatgtgcattgatcctgctgacaatgaactggaaactcttcaaatcatccatcactatgttgagatattggaccggtactttggcaatgtctgtgagctagacctgatattcaattttcataaggcctactttatattggatgagattttgattgctggtgaactccaagaatcaaacaagaaagcggttttgcgcctagttactacacaggacgctttggtggaagccgcaaaggaggaggcaagctcattgagcaacataattgcacaggctaccaagtagagcacttatgtcttgtacaatcattacccacacctcagagcatgatagtaacttaatcagtaccatacggcaacagctttcactctcaacttttccttgcagtttacctctgttacatctatgtagtttggtcagagatctgtcctgtctaccttttccttttatttattttcctgtataatccaataaagta

SEQ ID NO: 1838 - DNA, 561 bp, Thellungiella halophila
  misc_feature (278)..(278): n is a, c, g, or t
  misc_feature (286)..(286): n is a, c, g, or t
cgaatcgagcatcgctgttgcagattttctcaatttttagattcgaatagacatgatacattttgtgctcctagttagtcggcaaggaaaagtaaggctcaccaagtggtattcgccttatacacagaaggaaaggtctaaggtcatacgcgaactcagcggcgtaattctgaaccgaggtcccaagctctgcaattttattgaatggagaggatacaaggttgtctacaaaagatatgcaagcctgtacttctgcatgtgcattgatgaggcggatnacgagttngaagtactagagattattcatcactacgtcgagattcttgaccgttattttggcagtgtgtgtgaactcgatctgatttttaacttccacaaggcgtattatatattggatgagctgttgatcgccggtgagcttcaagagtcgagcaagaaaacagtggcgaggataatatcagctcaggatcaattggtggaggctgcgaaagaggaggctagttccataagtaatataattgctcaggctacaaagtagtttctttcttctctggtcttacg

SEQ ID NO: 1839 - DNA, 910 bp, Nicotiana tabacum
cgggggataagacattatttaaaaaaaaaaaaaaaaaaaaaaagctctacaagaaacacagtatacgaataatacgaacagaagaataagcttgttctctcacacattcaccttagcagaagaagaagaaggaagtggaggaggtgtttgttcttcggatcaccaatcatgattcactttgtgctgctcattagccggcagggaaaagtgaggctaaccaagtggtattcaccatatacacaaaaagagagaaccaaggtaatccgtgaactaagtggtatgattctcactcgaggaccgaagctttgcaattttgttgagtggagaggatataaagttgtttataaaagatatgcaagcctgtatttctgtatgtgcatagaccaagaggacaatgagttggaggtcctggaaatcatacaccattatgttgagattctggaccgatacttcggaagtgtctgtgagctggacttaatcttcaattttcacaaggcatactatatattggatgaacttgtgattgctggtgaactccaagaatcaagcaagaaaactgttgcacgtctaattgctgcacaggattctttggtcgaggctgccaaagaagaggcaagttctattagtaacatcattgcacaggccacaaaatgaaagaacgagggcattactgtttttatgattctcattcattgctgtaatcagatcttgttatgacattgtttctcttttcaatccatgttgcgtcatgcttcttattgaaatttctagttattaaaaggggagaatttcttttgtagtggtgatttttcctttgaacaaaggatgtctgcagtgatgtactttcttacctagaaactgctgtattcattctcgtccagttagttgataaatagcctttaccctttcg

SEQ ID NO: 1840 - DNA, 859 bp, Solanum lycopersicum
agaaaacacaaactagtaaagaaaaaaatacaagactgtacagaaaatagagtatatagaaataataggaataggaacaaaaaatcccccaactccaaagaagaagaaggaggagttgtttgtaccttggatctccagccatgattcattttgttctgctcattagccgacagggaaaggtgaggctaaccaagtggtattcaccatattcacaaaaagagagaaccaaggtaatccgtgaattaagtggtatgattctcactcgaggaccgaagctttgcaattttgtcgagtggagaggatacaaagtcgtttataaaagatatgcaagcctgtatttctgtatgtgcatagaccaagaggacaatgagttggaggtcctggaaatcatacaccattttgttgagattctggaccgatactttggaagtgtatgtgagctagacttaattttcaattttcacaaggcatactatatattggacgaacttgtgattgctggtgaactccaagaatcaagcaagaaaacagttgcacgtctaattgctgcacaggattctttggttgaggctgccaaagaagaggcaagttctcttagtaacatcattgcacaggctactaaatgagagtatgcaggcagcgttcaagtgttttgagtgcatttatgtttttcagctgtaatccaaacattatttcttctttcaatgttttcgtttaactttgtagttataaataggaatttctttgtagtaatgagttttcttctcaacctaagcgtggtgtttacttcactctgttgcctaaaaactgctggtcatatatatagtacttgttcctctggtggagctagcttataacg

SEQ ID NO: 1841 - DNA, 771 bp, Triphysaria pusilla
aacgaaataccgcaattagtcagggaactaattctaatcaatcagaaactgaagctagactctccgagaagaagaagaagaagagaattcaaatagaaccagctaatcagcagcaacttcaccatcgccatgattcactttgttcttctcatcagcagacaaggcaaagttaggttgaccaaatggtattcaccttacactcaaaaggagagaactaaggttctccgggagctaagtggtaatattctctctcgaggtcccaagctttgcaattttgttgagtggaggggatacaaagttgtttacaaaagatatgccagcctttatttctgcatgtgcattgaccaggatgacaacgaattggagacacttgagattatccaccactttgttgagatactagaccgctacttcggcagtgtttgtgaactggatttgatttttaacttccacaaggcttactacatattggacgaaatcctaattgccggtgaacttcaagagacgagtaagaaaaccgttgcgcgtctaatagctgcacaggattctcttgtggaggcagccaaggaacaagaaagctctataagtaacataattgcccaggcaacaaaatgaggggtttgtatcttatgatgtgtttttttctactaaaagattggttactaaatcaagttcttgtatcatgtgatatcttaatttctacttatgggatgatgcattttggacattattgtttttcattgaggtgtattcaagaagtgccgatgagga

SEQ ID NO: 1842 - DNA, 844 bp, Juglans hindsii x Juglans regia
  misc_feature (29)..(29): n is a, c, g, or t
  misc_feature (483)..(483): n is a, c, g, or t
cgtctcgagggcgagtagcctctttgtangcctctttaagaattcagagaagaagaagaagaagaagcgagtataattggcgtgtggtttaggaattactgagctttttgggcagtggcatttgatctcattgcaaaacaccccgagaaatgattcactttgtgcttcttattagtcggcaaggaaaagtgaggttgacaaaatggtattcaccttattcgcagaaggaaagaactaaggttatacgggagctaagtggagtgatccttacccgaggacccaagctgtgtaattttgttgaatggaaaggttacaaagttgtttataaaaggtatgctagcctgtatttctgcatgtgcattgatcaagaagacaacgaattagaggttcttgaaataattcatcattacgtggagattctggaccgatacttcggcagtgtctgtgagctggacttgattttcaacttccacaaggcctacnatatactggatgaactattgattgctggcgaacttcaggagcctagcaagaagacagttgcgcggttgatatctgcgcaggattcattggtagagaccgcgaaagagcagcgcagttcaataagtaatataattgctcaggctacaaagtagaggacaggcgtttttagttgcctaatatattgacattgaagtgctgtctgtatttttgttattctgtgtccgtcagccgtttaacaactggaatgcacctttttgttgtttgggttctcaagattgtacgattattgcctttctgttttttcctttgattacatgttgtatatggtttattcatcttccggatactggagatcattttt

SEQ ID NO: 1843 - DNA, 697 bp, Juglans hindsii x Juglans regia
atttgaagacgacgacgacgaaagaagcagcagcagctccttgtattggtatcagtggtggggggttttgagcttttcgggcagtggcttttgatctgatcgccaaccggcaaccgcacagagaaatgattcactttgtgcttcttattagccgccaaggaaaagtgaggttgacaaaatggtattcaccttatacacagaaggaaagaactaaggttctacgtgagctaagtggagtgatccttacccgaggacccaagctctgtaattttgttgaatggagagggtacgaagttgtttacaaaaggtatgctagtctgtatttctgcatgtgcattgatcacgaagacgacgagttagagatccttgaaataattcatcattatgtggagattctggaccgatactttggcagtgtctgtgagctggacttgatttttaacttccataaggcctattacatattggatgaacttctgattgctggggaacttcaggagtctagcaagaagacagttgcacggttgatagctgcacaggattcattggtggaggctgcaaaagagcagcgcagctcaataagcaatataattgctcaggctacaaagtaggggacgggcatatgtagttgccagatatatcggttgaaattgaagttacctgtattgttgttatcagtgtctttttcttttttctt

SEQ ID NO: 1844 - DNA, 947 bp, Triticum aestivum
acgcgatccagaccgcccagcacagacgccgacccacgccgctggcactcccgtctctcggcgatcctcccttctctggcgaccggctgtcaccccgtccgccctcgccgccagatccgcgcggccacgcccacccggcctcgctcctcctctcgggcctcggcagatctacgcgggcggcgaccctccctagccatgattaatttcgtgctcctaatcagccgccagggtaaggtgaggctcaccaagtggtactcgccttacacccagaaggagaggactaaggtcatccgtgagcttagtgggctcattcttactcgagggccaaaactctgcaactttgtcgagtggagaggttacaaggttgtgtacagaaggtatgccagcctctatttctgcatgtgtattgatgctgatgacaatgagcttgaagtccttgaaattatccatcattttgttgagatactcgaccgctatttcggcagtgtatgcgagctggatttgatattcaatttccacaaggcttactacgtactggatgagattctcatttctggtgagcttcaggagtctagcaagaagaatgttgcaagacttattgctgcacaggattcattggtagaggctgctaaagaggaagctggctccatcagtaacatcatcgcccaggctacgaagtaaaagtccgcgtctgatgatgcccctctgctctttggtttatgcttatgttggtaaatttgatgtaatagctcctttgctgtatccattttcccaaagaaatacgactccctggattcaggcctgttcagaatgagtgatatgtaattacaatgcatgtgttcctttgcaactgaatttggaatcttccaaagataaaactgtcatggagattgttcaccagtagtctgtttagtgggtatttaagaaatatttgtaaattcttggtc

SEQ ID NO: 1845 - DNA, 1044 bp, Triticum aestivum
acgcgacccagaccgcccagcccagcccagacgccgaccgacgccgctcgcgctcccgtctctcggcgatcctacctcctccgacgaccggctgcaaccccggccgccctcgccgccagatccgcgcggccacgcccacccgcctcgctcctcctctcgggcctcggcagatctacgcgggccgcgaccgtccctagccatgattaatttcgtgctcctaatcagccgccagggcaaggtgaggctcaccaagtggtactcgccttacacccagaaggagaggactaaggtcatccgtgagcttagtgggctcattcttactcgagggccaaaactctgcaactttgtcgagtggagaggttacaaggttgtgtacagaaggtatgccagcctctatttctgcatgtgtatcgatgctgatgataatgagctcgaagtccttgaaattatccatcattttgttgagatactggaccgttatttcggcagtgtatgcgagctggatttgatattcaatttccacaaggcgtactacgtactggatgagattctcatttctggtgagcttcaggaatctagcaagaagaatgttgcaagacttattgctgcacaggattcgttggtagaggctgctaaagaggaagctggctccatcagtaacatcattgcccaggctacgaagtaaaagtccgcgtctgatgatgccccgctgctctttggtttatgcatatgttggtaaatttgatgtaatagctcctttgctgtatccattttcccaaagaaatacgacttcccggattcaggcctgttcagaatgagtgatatgtaactacaatgcatgtgttcctttgcaactgaatttggaatcttccaaagataaaactgtcatggagattgttcaccagtagtctgtttagtgggtatttaaattaagaaatatttgtaaattcttggtcttaattcggcagcgcattatcttgtgtttaatcagactggttgttgtggccgtgctcatgttgtcctttggaaataaataaaataaat

SEQ ID NO: 1846 - DNA, 1096 bp, Triticum aestivum
  misc_feature (25)..(25): n is a, c, g, or t
aagctcgtgccgaattcggcacgangcgacccagaccgcccagcccagacgccgacccacgccgctcgcgctcccgtctctcggcgatcctcccttctccgacgaccggctgccaccccttccgccctcgccgccagatccgcgcggccacgcctaccccacctcgctcttcttcttaggccccggcagatctacgcgggcggcgaccgtccctagccatgattaatttcgtgctcctaatcagccgccagggcaaggtgaggctcaccaagtggtactcgccttacacccagaaggagaggactaaggtcatccgtgagcttagtgggctcattcttactcgagggccaaaactctgcaactttgttgagtggagaggttacaaggttgtgtacagaaggtatgccagcctctatttctgcatgtgtatcgatgctgatgacaatgagctcgaagtccttgaaattatccatcattttgttgagatactggaccgctatttcggcagtgtatgcgagctggatttgatattcaatttccacaaggcctactatgtactggatgagattctcatttctggtgagcttcaggaatctagcaagaagaatgttgcaagacttattgctgcacaggattcgttggtagaggctgctaaagaggaagctggctccatcagtaacatcattgcccaggctacgaagtaaaagtctgcgtcttatgatccctgcccctccgctcttcggtttatgtttatgttggtaaatttgatgtaatagctcctttgctgtatccattttcccaaagaaatatgacttcccggcttcaggcctgttcagaatgagtgatatgtaactacaatgcatgtgttcctttgcaactgaatttggaatcttccaaagataaaactgtcatggagattgttcgccagtagtctgtttagtgggtatctaagaaatatttgtaaattcttggtcgtaattcggcagcgtgttatcttgtgtttaatcagactggttgttgtggccgtgctcatgttgtccttaggaaataaataaaataaatgggtagtacaaccacaaccctagcaaaaaaaaaa

SEQ ID NO: 1847 - DNA, 1452 bp, Brachypodium distachyon
gcggcggcggggccatggcgaggggaatagcgcgcgcggcgtcgttcggcggccgcgcgaccgccgggtggttctcgtaccgccgcgtcaccgtggccgtctgcctcggcaacctcgtcgccgcgctgctcgtgctccgctccctcacctcctccgcccccgcgcccaaacgtgttgaagtggtgcagtataccgaggagcagattaggagggtggaggagtcgatccggattcgccgcgaggctgagcccatcgagctcgtccaggcggtgaagaagctgcggaaggttttcgcacgggaggagaaaaggcggaagaagctgccgctggagctgaagcagaaggtgtcatatgagattgtgtggcaactgcacgaattaggggataacagcagtgtcatccagcaacgagaagttctggaatcatggcgtgtcgagacgctaaaagatatcaagagtgcatctactcagaattcatcaaatttgggcttctccaatgaggaagcacgaatattaaagcgagccctggagttcaactggcatatgctattggaggacattggtctttggataccactagaaatctcacacaccgaacatgatgataaacctgacaatgaaccagaagaagaggagataatagcaggtccacctttggatccacaatgtaacgctgagctacatgctgattatggtggtgctgccgtgaaatggggcttaactcaccacaaagaatctgctgctgattgttgtcaagcatgtctagaccaggctaagaatgccaagccaggtgaaatgaagtgcaatatatgggtttattgcccatcagagtttggttgctattcaccggataaatatgagcataaacatcaggagtgttggttgaaacaggctgaccagcctaaactgaactttaaagacaggtattccgagtcttacagagattctcatcccagagcccctgttgttgtgccctggatgtcaggtgtcaccagcgcgtgagctgcttggcccgtgcagcccatttgagattgggagatttgcccggatgctgctttgctgacaaaccttcatatatattctttgtttgccacgatgcagttttctttttcaccggatatttcgccatgatggaaaacttagattagacgatctgatagcacaaggctcctttgagggaggcttgttgaggtaggggttaaaggatgcggtgtttatgaactaaatccaatgattcatctgagcccatggtgacctcccaatctcagttcgtggtcttctgtactattgtttttatgggcaggttctaaaatgcattgccggtcacatgtgatcatgggtgtgagcctgtgaggttgttaaagtgcttgaaattttaaggaggcacgaaaacaaaagcgtgaatatagagcatgctatataatatgaggacctataaagatttgacttgtga

SEQ ID NO: 1848 - DNA, 1573 bp, Zea mays
aatctgacaagtgggccacaatgattgtatcaacatagcctcccaacgcaacaaagggatttgcttcgtccgacgtccactacctttaccgccgcggcgccgccccagaatttcccccttcttcgttcgcggaaacgagagcgcccgaaggaatagcgaggtcggaggcgccgttcgattccagaagtttccatcgccgcgccgtgacgatcttgtgtagcctgcgcattggtctgctcgtcggacgtcggcgtcggtcgagtcgtggggtgcgcggtcgtgcgagatcgaggcggggagctcgcgaatcggaggccgcggggcgcaatgccgcgtcggtagggatggcggaggcggcgccatggcgaggggcgtagcgcgggcggtgtctttcgggcgccgtgccacaacggggtggtgctcctaccggcgcgtcaccgtggccgtctgcatcggcaaccttgtcgccgtgctgctcgtgctccgctccctcaccgcccccgcttccttcgcacccaccgctcccaaccgcggggaagtggtgcagtacacggaggagcagattaggtgggtggaggagtcgatccggattcgccgcgaggctgagcccgtcgagctcgttctggcggtaaagaagctgcggaagaaactcgcccaggaggtgaagcggcgggaggagctgtcgctggtgctgaagcagaaggtttattatgatattgcgcgggggctgcacgagttgggggataacagcagcctcgcgcagcaaagagaagtggtggaatcatggcgtgttgagaagttaaaaaacagtgcatccactcggaatcaatcaagtttggacttatctagtgaggaaaccagaatgttaaaacaagccctggagttcaactggcatatgctcctggaggatattggcctttggataccagatgaagtcacacatactgtacatgatgataaacctgaaaatgaaccagaagaagaagagatagtagcaggtccacccttatccccacaatgtaatgctgagctacatacagattatgatggcgccgctgttagatggggtttaacacaccacaaagaatctgctgctgattgttgtcaagcttgccttgatcaagctaagaatgccaagccaggggaattgaagtgcaatatatgggtttactgcccatcggaatttggatgcttctcgccagacaaatatgagcataaacatcaggagtgctggttgaaacaggctgaccaccccaaactgaacttcaaagacaagtattcagagccttacagagacgctcatcccactgcacctgttgtcgtgccgtggatgtctggtgtgatcggtgcatgagctgccagttgagactcctgctgatccaacttctacagacaacaatacagcttttctttttcttttcgtgactatactctttttccttttcttctttctgccccggtatatacgatgtaacctggcagcgaaaaattttgagggttgcttattggggtacacattggatttggtgttggttaattaaatttagtgaacagggattcacctattggtgat

SEQ ID NO: 1849 - DNA, 1514 bp, Sorghum bicolor
accgccgccccagaatttcccccccttcttcgtttgcggaaaacgagagcgcccaaacgaattgcgaagtctgaggcgccgtcagattccagaagtttccatcgccgtgacgatcgtgcgtagcctgcgcattggtctggttgtcggcgtcggtcgagtcgtggggtgcgcggtcgtgcgagatcgaggcggggagctcgcgaatcggaggccgcggggcgcaatgccgcgtcggtagggatggcggaggcggcgccatggcgaggggcatagcgcgggcggtgtcgttcgggggccgcgccaccacggggtggtgctcctaccggcgcgtcaccgtggccgtctgcctcggcaaccttgtcgccgcgttgctcgtgctccgctccctcaccgcccccgcttccttcgcacccaccgctcccaaccgcgtggaagtggtacagtatacggaggagcagattaggagcgtggaggagtcgatccggattcgccgcgaggcggagccggttgagctcgttctggcggtaaagaaactgcggaagaaatttgcccaggaggagaagcggcgacgggaggagctgccactggtactgaagcagaaggtttcttatgatattgtgcggcggctgcacgacttgggggataatggcagcctcgcggagcaaagagaagtggtggaatcatggcgtgttgagaagttaaaagacatcaaagttgcatccactcggaatcaatcaaatttggacctatctagtaaggaaaccagaatgttaaaacgagccctggagttcaactggtatatgcttatggaggatattggcctttggataccagaggaagtcaaacatactgtacatgatgataaacctgaaaatgaaccagaagaagaagagatagtagcaggtccacccttgtccccacaatgtaatgctgagctacatacagattatgatggtgctgcagttagatggggtttaacacaccataaagaatctgctgctgattgttgtcaagcttgtcttgatcaagctaagaatgccaagccaggggaattgaagtgcaatatatgggtttattgcccatcggaatttggatgcttctcaccagacaaatatgagcataagcatcaggagtgctggttgaaacaggctgaccaccctaaactcaacttcaaagacaagtattcagagccttacagagatgctcatcccaatgcacctgttgtcgtgccgtggatgtctggtgtcaccagtgcatgagctaccagtcccccagcagctcaattgagactcctgctgatccaacttaaacagacaaccatacagcttttctttttccttttgcgactatactcttttcttgttcttctttctgccccggtatatacaatgtaaaagtaaaacttagcttagtcgacctggcagcgaaagtttttgagcgatgcttgttggggtacacaattggatttggtggtggttaattgaattcagtggttcacctattggtgatcttcc

SEQ ID NO: 1850 - DNA, 1505 bp, Panicum virgatum
gccggccccgaatttcccccattccccctgcggcaagaggagcagcaaaatccggtgccgcggcctgattccagaagttccttgcatcgccgcgtcggcgtcgatcgagcgtagccagcgcattggtcattggtgtcggtcgcgcggtgcggcgctcgtgcgagatcgaggcagagcaatgctgcgtcggtagggatggcggcggcagcgccatggcgaggggcatagcgcgggcggtgtcgttcgggggccggtcgaccgcagggtggtgctcctaccgtcgcgtcaccgtggcagtctgcctcggcaacctcgtcgccgcgctgctcgtgctccgctccctcaccgcccccgcctccttcgctccaacccctctcaaccccgacgtggtgcagtacacggaggagcagattaaaagggtggaggagtcgatccgaatccgccacgaggcggagcctgtcgagctcgtgcgagcggtgaagaggctgcagaaggttttcacacgagaggagaagcggcggaaggagctgccactggagctgaagcagaagatctcgtatgatattgtacagcggctgcaggacttgggggataatggcagccttgcacagcaaagagaagctgttgaatcatggcatgctgagaagttaaaagacctcaaaagtgcatctactcaaaatcagacaaatttggacctatccagtgaggaaactagaatgttaaaacgagccctggagttcaactggcatatgcttatggaggatattggcctttggataccagaggaagtcacgcatactttgcatgatgacaaacctgaaaatgaaccagaagaagaagagataatagcaggtccacctttgtctccacaatgtaatgctgagctacatactgattacgatggtgctgctgttagatggggcttaacacaccacaaagaatctgctgctgattgttgtcaagcttgtctcgatcaagctaagaatgcaaagccaggggaattgaagtgcaatatatgggtttattgcccatcggaatttggatgctactcgccagacaaatatgaacataaacatcaggagtgctggttgaaacaggccaaccaccctaaactgaacttcaaagacaagtattcagagtcttacagagatgctcatcccaccgctcctgttgtcgtgccatggatgtctggtgtcatcagtgcatgagctaacagtctcccagcagctcaattgagattcgtgctgatgcaaatgcaacttcgacacagccatacattttttcctttttcttcactatactgccttgtttttcttctcctttatgacctggcatatacgatgtaaaacttagcttagttgactcggaagcaaaagtttttcagggatgatgttgaagtacagttggaattggtagtggtgaacttgattcatatacgagttatcttccaactttactcttgaacctggtcgatgtttttgtgatcatgagttcatgcggtgccc

SEQ ID NO: 1851 - DNA, 2351 bp, Oryza sativa
agtagtgtggtaggcgtagaagaaaatggggtaggtgtgtagaaggagcgattgtgccagcgatgacgatgcttccggcgacggcggcggcgctgctggtgctggtgctgcagctgatgtggtcggcggaagcgcaggtggcggtgggctcagggccgccggcgggctgcccggacaggtgcggcaacgtgagcgtgccgttcccgtttggcatccgcgacgggtgctccctcgagggattcggcctcacctgcaacaccacgagcaatcccccgcgcctgatgatcggcaacagcacactgcaagtcgtcaacatctcgctggccaactccacgctgcgcgccgtcgacatcgacggcgccgtgaacatcacctacgggcagatcgacggcaacggcacgtgggtcggcgtcgtcgcgagcccgtacatcgtgaacgagaccctgaaccagctcctcgtcacggggtgcaacatccaggtaacccttgtcggcagcggcgggaacgtcatctccggctgctcttccttctgctccatcaacgacatgtacacgggtggcgtgttcagaagcccaggcaacaagtgcgcgggcatcggttgctgccagcagcaggtctccatcggccgcccctcctaccgcgtggaattgacgaacctggacagggatcgtgagttcagcggtagggtgcccgaagcggtgcgcatcgccgagctgggctggttcgacggcctcgccgccgacctgctcaacgtgtcgttggcggacacctcgcgccggaacccggttccggtggtgctggattgggcggtggcgtccaccggcctggatgtcacgctcaacgccgggctgaacaaacaggctgccaataactggtcctgccccacggccgcctcgggcaggaagagcgcgtgcataagcagcaacagcttctgccgcaacatcgccgacaactaccgaagcggttacgtctgccgttgtgacaaggggtacgacgggaacccgtacgtcgccggcggatgccaagacatcaacgagtgcgagcgggcgaaggagaacggctgcttcggcgagtgcaccaacacgccgggagccttcttgtgcaggtgcccgcacggtgcccgtggtaacgccaccattccaaatggctgcaccaaatccaatctaggtttaacaattggagttggaattggtagtggtgccggcctttttatcctggcacttggtgctgtctttttaacacgtaggattaaacaacggagagcaagaacactgagacagaagttcttcaaacagaaccgtggccatttgttgcaacaattggtatctcaaaaggccgacattgcggaaagaatgatcatccccttggcagaactagaaaaggccacaaacaactttgacgaatcgcgtgagcttggaggaggaggacatggcaccgtatacaaaggtattctctcaaaccttcatgttgtcgcaatcaagaaatcaaatgtgacagtccaaagggagattgatgagttcataaacgagaccgaagtgccattgttggtttatgaattcatatcaaatggtacactttatcatcatcttcatgttgaaggaccaacatcgttgccatgggaagataggctcagaattgctactgaaacagctagatccctcacttaccttcactctgccgtgtcatttcctataatccatagggatatcaagtcccataatatcctattggatggctcactaacagcaaaagtctcagactttggagcttcaaggtgcatcccaactgaacaaaatggggttacaactgctattcaaggaacactaggatacctagaccccatatattactacacaggacgtctcacagataagagtgatatttatagcttcggcgttgttttaatggagttgcttactaggaaaaaaccatattcatacagatcggctgaggatgagagccttgttgcacatttcagtaccctacatgcacagggcaacttgggtgacatacttgatgcgcaggttatagaggagggaacaaaggaagttaatgatgtagccacattagctgtggcatgtgccaagttgaaagcagaagagcgaccgactatgagacaggtggaaatgacactcgagagcattcggcaagaagtactgcatagtgtgagcacaaagaaatctaaggagcttcacgtctcatggaaccatgcaataagtgaggggagtatcttctaccaagctgtcgacacttcaattgtaatagttagcgatgttggttccagcgataacttgtgcgacggcgctgtgatcggcagaaacagatttccggggacgcaatgccggcagtga

SEQ ID NO: 1852 - DNA, 3250 bp, Zea mays
gataggggtctttcggtaatttttcgaggagttggggagggagggattcgaccggcggcgatcgggataggcggaggccggcgagagcgatggaggaggaggtgacggggagcggcgggggaattgggcggaagatggcagcgggggaggtggatcttaaggagaaatcggggacggcgtggagccactcgtacctcaaccagaagccgtggcacccgctctcgtacccgaaccagcgccgcaagtggatcgccgagcaggtccacgccaatcacgcgcgccgccaggaggaggtgcagcgggagttcgcacaggaacaggagttcttccggcagaccgcactcttctctaagaaggacaaggagaagatggaggtaatgaaagctgtgagttttatgtacgtgcgcccaccgggatacaatgcagagagtgcaaaagctgctgaaattgaagatgagaagaagaggtcggatccaggtgacatgggtactgcatctgcaagtacctcttcaatacctgacaagggacctgaaaaggctaaatcaggcgcagataagaaaaataggccaaaagatgtttttggtcggccattggcaacagaacaagaatttgaagttctcaagaatgctccaaggttagacacaggtgctcctgcaagggtcaaaccatttggagttgaagttcgtaatgttagatgtttaaggtgtggaaactatggtcaccaaagtggtgaccgggaatgtcccttgaaggatgcaatcatgcctaacgaggagagtcggttgaaaagagacgatccacttacaactataatggcgcagacggattcaagtgagcctctgaagtgggaacttaagcagaaaccaggcatgagccctcctcgtggtggatttgacccagatgatcctaatcagcagattgtggcagaagacatctttgatgaatatggaggttttctgggcaactgtgatatcccagctctcatttccaatttttctgctaccaaatccaagaaacgttccaagaagaaaagcaagcacaagcaggctaagtctgctattcatgaggactctggtagacatgaaagcagttaccatctatcatcggactttgacaatgagaagagaaacataacatcaagaagcaagagaaagaaagcaaactgttctgattcatcatattctgattccgagatagatgctagaaaaggcaagagcaagtcaaagcataagcatacgaagaaataccagttaaagtcttctgattcagaatttgatgtccgtgaagatacaaggcggcgtctgaagagagaccacatgaaggagaaaagagatgagtcaccattgccgttctctaaggatcaaggagacacagaaggcaagaggcattcaaggtgttcaagggagaagcacaactacagttattcatcgagttcttctgagagaggcaggcggcgttcgagggagaaacgtcactacagttattcaccaagttcttctgagagaggcaggcattctctacggcacaaggagaaacaatattacagtgactcaagttctgatcggagccatcgacactcgagaagatcgagggagaagagacatgatagagactcaagttctcctgatgccatcaggcgctcaagtagatcgacggagaaacagcgccgtcctgatacaagcccacgtcatgccaacgggcattcaaagaaatcaagtggcaagcaagactatactgagcgtagccgttacgaaaccagtagacattcaaggagatctcaggagaaacggcactaccctgattctagcgcctctgattactcggactctgatcagcacaaaaaacatcgccaccatcataggagaaaatgaactggcagtgtataagagcccaaccccaactccacaagcaaagatgctgtcgtcttccacctccaccctccgcctccaccaaccaacccgaccccaccggcgccacccgccggccccggccttgggggtcgccacccacctggcctccccgcggcggtggcgcggacacgccccgggggcgggggcgcccctccgcgcgcggccccagcgcatccgcgcggtggacgccgcccagccgttcgactacgagtcccgcgcggcggggctgctggaggagcggcagcggctgaagatcgccatcgtcgggttcggcaacttcgggcagttcctggcgcgcacgttcgcgcggcaggggcacacgctgctggcgcactcgcggacggaccacacggcgctggcgacgacgctgggggccaccttcttcgcggacccgcacgacctgtgcgagtgccacccggacgtggtgctcctggccacctccatcctgtcggccgaggccgtgctgcgctcgctccccgtgcaccgcctccgccgcaacacgctcttcgtggacgtgctgtccgtgaaggagttccccaagaacctgctgctcagctccctgccccccgactttgacgtcatctgcacgcaccccatgttcgggccggagtcggcgcgcgacggctgggacggcctgcccttcgtgttcgaccgggtccgcgtcggggactgccccgcgcgccgcgcccgcgccgacgccttcctcaacatcttcgagcgcgagggctgccggatggtggagatgtcctgcgccgagcacgacgcgcacgccgccgagacccagttcctgacgcacaccgtggggcggatgctcgccatgctggagctgcgctccacgcccatcaacaccaagggctacgagacgctgctccgcctcgtggacaacacctgcagcgacagcttcgacctctacaacggcctcttcatgtacaacaagaactccaccgagctgctcaaccgcctcgagtgggccatggactccgtcaagaagaggtttttcgacggcctccacgacgtgcttcggaagcagcttttcgaggggtccccgcacgcccccgacgtttcttcctccaacgtccgcaagtagacacggccgccgccgggggggggggggggggttcgtctcgcccccaatctcatcatcatctgttgttagtaataaattaaattccagttccaattctccttgccattgtatttgtagtaccagcctgtatctgtattttccgtttctcctcccaactccctcctgtcagttcagttttacagttgagggatgaaatgtggcagcttggcattgcaatttgtgacaaacaaactgaataaataagcaatctttg

SEQ ID NO: 1853 - DNA, 1606 bp, Brachypodium distachyon
ccttgtcttcctcctcgagcgagcgccgccaccgctgccgagcgccccagccccctcgctccgtcgctcgtcttcctcctcgtgcgagcgcctccaccgcagatatctatctcccctgcaattctctcgttcccgaccgtttctcctcccatcaccccacgaacagatcccgccctttagcttcccgttgcatctcctccgcccttgggtaagatggccaaggaaggagcaggaggagggccggactggaacggcctgctcaagtggagcctcgcccacggcgacggcaccaacccgccgcgcgccctcagcgaggaggacaggaaatggtttatggaggcaatgcaggcgaatacgatcgatgttgtcagcaggatgaaagagatcacccaggtgatgaagacccctgacgatgtgttgcagtctcatggtgtgactccagagaacattgaagatatgttggatgagttacaagagcatgtggagtcgattgatatggcaaatgatctccattctattggtggattagatcctctacttggttacttgaaaaattcacatgctggcatccgagcaaaggcagcagaagttgtgagtacaattgtgcaaaataatccgaaaagtcagcagcttgtcatggaatctaatggactggagccactgttgacaaacttcaaatctgatcctagcacaactgcccgcacaaaagctcttggagcaatatcttctctggttcgtaataaccaacctggacttgctgccttttgcctaggaaatggctatgctgcactgaaagatgctcttggttctgatgatgctagacttcagaggaaagctctacatctcatgcaatacctgttagacaacaaggcggataggagcgttgctacagagcttggtctcccaaatctaatgatgcacctcgcctccagcgacgatgctggagttcgagaggccgccttaggcggtctccttcagctggcacgggacaagacacccgctgctggcaacaccctacctgatcaagacaagctgaaagatgtcctcaggagccggatcgaaggcatcagctcaatggacgctgatgacctccatgcagcccgtgaggagcggcaactcgtcgactctctctggaaggagtgctacaacgagccatcgtctctcagagagaagggcctcgtggtgctccccggagaggatgcgccccaacagccgccaccagatgttgccgggaagatgttcgagccaccactccgcgcatttgctgcggtctcgtccgaaggttctgactccggcagtgggaagaaggatccacccttgctgctaggcccatgaacgtcatccagctccagttcgacctcgtagtggccagtaggggtattctggaaggctgaagaccaggcatggtaggatttggatgattttgcatgtacaaccttatatgctacggtggttgtatgacgctgatcagctctgcgttttcattttagcgtttgcctgtacggttctggcagatgcttgtattattattgctctgcttttcttaaccttgctcagatggttagatgcttgttcaatctgacatatttgccccagcaaccatgga

SEQ ID NO: 1854 - DNA, 1613 bp, Cenchrus ciliaris
gttcgggagtagtctggaatccgccgccgcatctacacgacgccacaactgacgacggggagcccctgctctccaccgccgcttccgcgcaccaaaccccataaaaggcggaggaagaccttgcagcgagaaccctaccgatctcgcctgaagcaattcgccttgcccgttcgtctcgcctcatcgtgcgcagcagcagcggcagcagcatcagaacggagatggccaaggacgggggccccgactggaacggcctgctcaagtggagcctcgcacacggcgacggcaccaacccgccgcgcgctctcagcgaggaagacagaaaatggttcatggaggccatgcaagccaacacaatagatgttgtcaagaggatgaaggagatcactcaggtgatgaaaactccagaagatgtcttggagtctcaaggtgtgaccccagagaacattgaagatatgttggatgagctacaagagcacgtggaatccattgacatggcaaatgatctacattctattggtgggttagatcctctacttggttacttgaaaaattcacatgctggcatccgagcaaaggcagcagaagttgtgagtacaattgtccagaacaatcccaagagtcagcaacttgtaatggaatccaatggactggaacccctgttgacaaacttcaaatcggacccaagtacaagtgcacgcacaaaagcattaggagccatatcctctctgattcgtcataaccagcctggtatatctgcatttcgcctgggaaatggttatgctggactgaaggatgctcttggttctgatgatgccagactccagaggaaagctctcaatctcacacaatatctgctgcacaacaacaaagctgacaggagcatagctacagagcttggtcttccaaagctgatgatgcacctcgcatccagcgatgattccttagtgcgtgaagctgcgttaagtggtctcctggagttggcacaggacaaaacatctggcaacactctacccgaccaagacaagctgaaagacatcctcaagagccgaatcgaagggatcagcacgatggacaccgacgaactccatgccgctcgtgaggagcggcagctggtggactcgctctggaaggagtgctacaacgagccgtcatccctcagggagaagggcctcgtggtgctccctggagaggatgcaccccaacagcccccaccagacgtcgcggggaagatgtttgaaccgccacttcgcgcctgggcagctgcaagacctgcacctaaagatgattttgataatggcagcgagaagaaggatgccccgccgttgctgcttggccctggaccgccttccaactccaatttttagacctgtcacgtttgctcccgacctgaggggagtatcttgacttttggtctgtgcaaactcccgtagtcgtattttgatgacatggtctgcattttgtttcagggtatggtttgtgttttgtcggggggatacttgtatcctctgatgctattaaattaatgctacttgtgaattctctttgcgcgacagttcaattttgatgttttcaaaaaaaaaagtttaatcggattgttgtgttgctggtga

SEQ ID NO: 1855 - DNA, 1548 bp, Leymus cinereus x Leymus triticoides
  misc_feature (50)..(51): n is a, c, g, or t
  misc_feature (55)..(55): n is a, c, g, or t
  misc_feature (58)..(59): n is a, c, g, or t
  misc_feature (64)..(65): n is a, c, g, or t
  misc_feature (74)..(74): n is a, c, g, or t
  misc_feature (82)..(83): n is a, c, g, or t
  misc_feature (85)..(85): n is a, c, g, or t
  misc_feature (91)..(91): n is a, c, g, or t
  misc_feature (93)..(95): n is a, c, g, or t
  misc_feature (97)..(97): n is a, c, g, or t
  misc_feature (99)..(99): n is a, c, g, or t
  misc_feature (101)..(101): n is a, c, g, or t
  misc_feature (108)..(108): n is a, c, g, or t
  misc_feature (129)..(129): n is a, c, g, or t
  misc_feature (134)..(134): n is a, c, g, or t
  misc_feature (138)..(139): n is a, c, g, or t
  misc_feature (809)..(809): n is a, c, g, or t
  misc_feature (1155)..(1155): n is a, c, g, or t
  misc_feature (1168)..(1168): n is a, c, g, or t
  misc_feature (1178)..(1178): n is a, c, g, or t
  misc_feature (1183)..(1183): n is a, c, g, or t
  misc_feature (1186)..(1186): n is a, c, g, or t
gaacactacaaaaggagaggaaggcaaccaagagcgaaccggcttgctanncacnacnncctcnnccgcgcgcncgcacgcnncnaggaancnnncncncnggcaccngcagcagcgtctctccggcgncaagngtgnngagatggccaaggatggagcaggagggggccccgactggaacggcctgctcaagtggagcctcgcccacggcggcgacggcaccaacccgccgcgcgcgctcagcgaggaggacaggaaatggtttatggaggcgatgcaggcgaacacaatcgatgttgtcggcaggatgaaggagatcgcccaggtgatgaaaacccctgatgatgtgttgcagtctcatggcgtgactccagagaacattgaagatatgcttgatgagttacaagagcatgtggaatccattgatatggcaaatgatcttcattctattggtggactagatcctctacttggttacttgaaaaattcacatgctggcatcagagcaaaggcagcagaagttgtgagtacggttgtccagaataacccgaaaagccagcaacttgtcatggaatctaatggactggagccactgttgacaaacttcaggtctgatcctagcacgaccgcacgcacaaaagctctgggagctatctcttctctgattcgtaataaccagcctgggcttgctgcatttcgtctaggaaatggctatgctgcactgaaagatgcacttggttctgatgatgctagacttcagaggaaagctctgcatctcacacagtacctgctgaacaacaaggcggatnggagcgtcgccgcagagattggtcttccgaatcaactgatacaccttgcatccagcgacgattctggagtccgggaggctgccctgggcggccttctcgagctggcgcgcgacaagacaccagctgcccacaacgctctacctgatcagaacaagctgaaagacgtcctccggagccgaatcgaaggcatcagcgcaatggacgcggacgacctccaagcagcccgcgaggagcggcaactggtggactccctctggaaagagtgctacggcgagccgtcgtctctcagggagaagggcctcgtggtgctccctggggaggacgcgccgcagcacccggacgtcgnggggaagatgttngagccgccgntccgngcntgggccgcgccgaggcctgctccagcggaggactctgattcgggcagcgggaagaaggatccgcccttgctgctaggcccgtgaccctcttacggctcaagttgttaatggaacccagcggatattgtggaaggctgaagaggaggtgtgtatggtagaagtctagtgattctgcccgtagtaacctttatttgccccaatgattgtactactacgcggatcagctgagaggttgatttgagcgtcttctgcgagtttgaaagataatttgtgttattatccgctgtctcttgaacgatgatcttttttgagaggttgaacgatgatcttagtacacgcttgttggaggctggcaaaaaaaa

SEQ ID NO: 1856 - DNA, 1648 bp, Zea mays
tcgtggcccacggacgtgtaggaggggacacgccgccgggcctcactaaccgcaggttcgggagtactccggaacccgccgccgcatccacacgacgccacgactgacgacggagagccccggtctccttccacggctccaccgccaccaccccgcataaaagtagggaagagagccttgcagcgagaaccgtatcgatctattctcgtctgaagcaattcgcccctgtcgtgagcagaaccctacagctcgtattcgcctcatctcgcagcagcagcagaagaacaagggtatggcgaaggatgggggtcccgactggaacggcctgctcaagtggagcctcgcccacggcgacggcaccaacccgccgcgtgctctcagcgaggaagacagaaaatggttcatggatgctatgcaagccaacacggtagatgttgtgaagaggatgaaggagatcactcaggtgatgaaaactccagaagatgtcttgcagtctcagggcgtgacccctgagaacatcgaagatatgttggatgagctacaggagcatgttgaatccattgacatggcaaatgatctacattctattggtgggctggatcctctacttggttacttgaaaaattcaaatgctggcatccgagcaaaggcagcagaagttgttagtacaattgtgcagaataatcccaagagtcagcaacttgtcatggaatccaatgggctagagccactgttgacgaacttcaaatcagatccaagtacaaatgcacgcacaaaagctttaggagccatatcttctctaattcgtcataaccagcctggagtttccgcatttcgattgggaaatggctatgctggattgaaggatgctcttggttccgatgatgccagactccaaaggaaagctctcaatctcatacaatacttgctgcacaactacaaggcagacaggagtgttgccacagagcttggtcttccgaagctgatgatgcaccttgtgtccagcgatgattccttagtgcgtgaagctgctctaggcggcctccttgagttggcgcgggacaagacatctggtaacgcgctacctgaccaagaaaagctgaaagacatgctcaagagccgaatagaagggatcagcgcaatggacactgacgatctccacgctgctcgcgaggagcggcagctggtggattcactctggaaggagtgctacaacgaaccttcgtctctcagggagaagggcctcgtcgtgcttccgggagaggatgctccccaacagccgccaccagacgttgcagggaagatgtttgagccaccgcttcgtgcgtgggcggctgcaagacctgctcaggaagatgactctgactctggcagcggaaagaaggatccgccattgctgcttaagttttgacggccttcttatgccgatactagttcttaggctccaccatgggtgttgaaagctgaaagatcagatctgatggatgcctgaccttcttcgaacctcagttgtggttcttgtaatttgcaccgcatttctgttctgagtatgtttttatgagaagactgggaagatgacagacagatactgtatcacgtgatgctcgtaaattaacactacatgcgaattctcttgctcgattgctca

SEQ ID NO: 1857 - DNA, 1552 bp, Oryza sativa
aggaacactccggactcctccgccgccgcgtcccccgtctctctcgacgacgcctcgactgacgagaggaggagacctctccctcccataaaagggggaggacgagggcgaggaagaggaggaggcttgtgctgcttcgtcttttcccgccgccgcgcaccgacgcctgaaccaactgtctcgccgtgaaccctcgccggagttggtagaggaggagatggccaaggacggaggagggcccgactggaacggcctgctcaagtggagcctcgcccatggcgacggcaccgccaagccgcgctcgctcagtgaggaggacaagaaatggtttatggaggcaatgcaagctaatacaatggatgttgttaagaggatgaaggagatcacccaagtgatgaaaactccagatgatgtactacagtctcaaggtgtgactccagagaacatcgaagatatgttggatgagttacaggagcatgttgaatccattgacatggcaaatgatctgcactctattggtggattagatcccctacttggttacttgaaaaattcacatgctggcatcagagcaaaggctgcagaggttgtgagcacgattgtgcaaaataaccccaagagccagcaacttgtcatggaatctaatggcctggagccactgttgacaaacttcagttccgatgcaagcacgaattcacgcacaaaagctcttggagcaatatcatctctaattcgtcataaccagccaggagttgctgcattccgcctgggaaatggctactctgcactgagagacgctcttggttctgatgatgctagacttcagaggaaagctctccatctcctacagtacctactgcacgacaacaaggctgataggagtgttgctacagagcttggtcttccaaagctgatgatgcacctggcatcgagtgatgattctggagtccgggaggctgccttaggtggtcttctcgagctggcgcgggacaatacatccggtgctggaaacgtgctacctgaccaagacaagctgaaagatgtccttaagagccgaatcgaaggcatcagcacaatggatgccgacgatctctccgcacatcgtgaggagcgacagcttgtggactccctctggaaggagtgttacaacgagccgtcgtctctcagggagaagggtcttgttgtgcttcctggagaggatgcacctcaacagccaccaccggatgtcgttggcagcatgtttgagccgccgcttcgcgcttgggcagcatcaaggccacctcccaaagaagattcagagtctgagagcgccaagaaggatccaccattgctgctaggccctggaccgtcttcctagacttgttgggattgcttagtttttcgcttatgcaattctctagacttaaccttaaaaagatcctacatatttgcaatctgctgaaattctctgcattttaatcctgtcctgagctcttggatgtattgaggtttttggatatctgtaatctgtgatgctattaaaatacgaagatgaaagatacttatctcttcc

SEQ ID NO: 1858 - DNA, 1646 bp, Sorghum bicolor
tggcccacggacgcccaggaggggacaccgccggccacacaaaccgcaggttcgggagtactccggaacccgccgccgcatccactcgacgccacgactgacgacggggagccccggtctccctccaccgccaccgccccacataaaagaagggaagagagccttgcagcgagaagccgagaaccctatcgatctcgcctgaagcaatccgcacctatcgtgagcagaaccctacagttcgtctcgcctcatctcgcagcaccagctgcagaagaagaacaagggggatggcgaaggatgggggccccgactggaacggcctgttcaagtggagcatcgcccacggagacggcaccaaaccgccgcgtgctctcagtgaggaagacagaaaatggttcatggaggctatgcaagccaacacgatagatgttgtcaagaggatgaaggagatcactcaggtgatgaaaactccagaagatgtcttgcagtctcagggtgtgaccccagagaacattgaagatatgttggatgagctacaggagcatgttgaatccattgacatggcaaatgatctacattctattggtgggttggatcctctacttggttacttgaaaaattcaaatgctggcatccgagcaaaggccgcagaagttgttagtacaattgtgcagaataatcccaagagtcagcaacttgtcatggaatccaatggactcgagccactgttgacgaacttcaaatcagatccaagtacaaatgcacgcacaaaagctttaggagccatatcttctctaattcgtcataaccagcctggaatttccgcatttcgcctgggaaatggctacgcgggattgaaggatgctcttggttctgatgatgccagacttcaaaggaaagctctcaatctcatacaatacctgctgcacaacaacaaggcagacaggagtgttgctacggagcttggtcttccaaagctgatgatgcaccttgcgtccagtgatgattccttggtgcgcgaagctgctctaagtggcctccttgagttggcacaagacaagacatctggtaacgttctacccgaccaagacaagctgaaagacattctcaagagccgaattgaaggaatcagcgtgatggattctgatgatctccatgctgctcgcgaagagcggcagctggtagactcgctctggaaggagtgctacaacgagccttcgtctctcagggagaagggcctcgttgtgcttcctggagaggatgcgccccaacagctgccaccagatgttgcaggaaagatgtttgagccgccgcttcgcgcgtgggcagctgcaagacctgctcaggaagatgattctgattctggcagcggaaagaaggatccaccattgatgcttaagttttgacggtctccagataccaatcccagttcttaggcctgatggatacctgcctgttgccctgttatgcacacactatcatcgtgtatggttcagtagcggttaatgtgctcagcatttcggttcagagtttgctttctgagacacagacgatgacatatattgtattatgtgatgctcgtaaattaatgctacatgtgaattatcttgcacgatagttaatttcatttttctgatgcttccatg

SEQ ID NO: 1859 - DNA, 1800 bp, Saccharum officinarum
  misc_feature (524)..(524): n is a, c, g, or t
  misc_feature (891)..(891): n is a, c, g, or t
  misc_feature (1019)..(1019): n is a, c, g, or t
  misc_feature (1035)..(1035): n is a, c, g, or t
  misc_feature (1077)..(1077): n is a, c, g, or t
  misc_feature (1098)..(1098): n is a, c, g, or t
  misc_feature (1483)..(1483): n is a, c, g, or t
  misc_feature (1512)..(1512): n is a, c, g, or t
  misc_feature (1567)..(1567): n is a, c, g, or t
aactggtcacctgctctaccgctgcgccgttccggaatcgacccacgcacccagcgcggacgagcctggtagcgtggagcgccaggcggcacacacagacacgcagcatggtcgaggctacacgagcacgcggcgacgaatccgcaccaggccgccactgacgacggtagtactccctccgagtcatcgtactccctccaccgccacctccccgcataaaagcagacaagagagctttgcagcgagaggccgaggaccccatcaatctcgcctgaagcaatcggcagctatcgtggtgagcagaaccctacagttcgtctcgcctcatctcgcagcaccagctgcagaagaagaacaagggggatggcgaaggacggggcccccgactggaacggcctgttcaagtggagcatcgcccacggagacggcaccaaaccgccgcgtgctctcagtgaggaagacagaaaatggttcatggaggctatgcaagccaacacgatagatgttgtgaagaggatgaaggngatcactcaggtgatgaaaactccagaagatgtcttgcagtctcagggtgtgaccccagagaacattgaagatatgttggatgagctacaggagcatgttgagtccattgacatggcaaatgatctacattctattggtgggctggatcctctgcttggttacttgaaaaattcaaatgctggcatccgagcaaaggcagcagaagttgttagtacaattgtgcagaataatcccaagagtcagcaacttgtcatggaatccaatggacttgagccactgttgacgaacttcaaatcagacccaagtacaaatgcacgcacaaaagctttaggagccatatcttctctaattcgtcataaccagccnggaatttccgcatttcgcctgggaaatggctatgctggattgaaggatgctcttggttctgatgatgccagacttcaaaggaaagctctcaatctcatacaatacctgctgcacaacaacaaggcagncaggagtgttgctacngagcttggtcttccaaagctgatgatgcaccttgcgtccagngatgattccttggtgcgcgangctgctctaagtggcctccttgagttggcacaggacaagacagctggtaacgctcttcctgaccaagacaagctgaaagacatcctcaagagccgaatcgacggaatcagcgctatggactctgaagatctccatgccgctcgcgaggagcggcagctggtggactcgctctggaaggagtgctataacgagccttcgtctctcagggagaagggcctcgttgtgcttcctggagaggatgcgccccaacagctgccaccagatgttgcaggaaagatgtttgaaccgccacttcgcgcgtgggcagctgcaaaacctgctcaggaagaaggttctgattctggcagcggaaagaaggatccgccattgatgcttaagttttganggtcttcagataccaattccagttcttangcttggtgatgggtctggaaggctgcaagagcagacctgatggatgcctttcttntgccctgtgcacacactacatcatccctgttgggtcaagtagcgggtctgaaaatgtgcttttgcattttggttcagagtttggctttttgagaacgccaaaccaagacattatattggattatgtgaagcctcgaaagttaaacactaacttgtggaattctcttggaccaaaagttactttccatttctcttgacggtttcatgatttaatttggataccgaattggtttg

SEQ ID NO: 1860 - DNA, 1639 bp, Panicum virgatum
gggcgtccgcagtccgcgcaccgcaggttcgggagtactccggaatctgccgcgccgccgccgcatctacccgacgccacgactgtcgacggggagccgggccgggtctccaattctccaccgccgcttcgccaccccataaaagcagagcaagagccagcttgcggagagaaccctaccgatctcgcttgaagccatcgccttttgccgttcgtccctcatcgtgcgcagcagcatcagcagcagcggaacggagatggccaaggacgggggccccgactggaacggcctgctcaagtggagcctcgcccacggcgacggcaccaacccgccgcgcgctctcagcgaggaagacagaaaatggttcatggaggccatgcaagccaacacaatagatgttgtccagaggatgaaggagatcactcaggtgatgaaaaccccagaagatgtcttggagtctcagggtgtgaccccagagaacatcgaagatatgttggatgagctacaagagcatgtggaatccattgacatggcaaatgatctacattctattggtgggttggatcctctacttggttacttgaaaaattcgcatgctgtcatccgagcaaaggcagcagaagttgtgagtacaattgtgcagaacaatcccaagagtcagcaacttgtcatggaatccaatggactgcagcccctcctgacaaacttcaaatcagatccgagtacaaatgcacgaacgaaagctttaggagccatatcctctctaattcgtcataaccagcctggaatatctgcatttcgcctgggaaatggctatgctggattgaaggatgctcttggttccgatgatgccagacttcagaggaaagctctcaatctcatacaatacctgctgcacaacaacaaggcagacaggagcgtagctacagatcttggtcttccgaagctgatgatgcacctcgcatccagtgacgattccttagtgcgtgaagctgcattaagcggtctccttgagttggcgcaggacaagacatctggtaatgctctacccgaccaagacaagctgaaagacatcctcaaaagccgaatcgaaggcatcagcttgatggatgccgacgatctccatgttgctcgtgaggagcggcagctggtggactcgctctggaaggaatgctacaatgagccctcatccctcagggagaagggtctcgtggtgctccctggagaggacgcaccccaacaacccccaccagacgtggtggggaagatgtttgagccgccgcttcgcgcatgggcagctgcaagacctgctccgaaagatgattctgattccggcagtgagaagaaggatgcgccgccgttgctgcttggccctgggccgtcttccaacaattcttagactcggtcgcgtttgtggaaggctgaaatagcagacctgatggaagtccttaacttcttgcgtgtgcaaactcctgtggtcgtattctgatgatgtcctctgcattttgtttcggagtttgctttgtgcagaggttaatatacttgtattctgtgatgctattgagttaatgctagtacttatgaattctctttgcacgaaggttaaatttcgatgctacggtggcagtgttgtggctcc

SEQ ID NO: 1861 - DNA, 1664 bp, Triticum aestivum
ctccgcaggttctagagcactccagacccccgccgccgccgagcggtccctccgtctccaccacaccacgccacggccgaccaaggcgaggagagaccaaccaaaccaaagagagcactacaaaaggaggagggagagagccagaagctctaccacgttcgaccacgcacgcacgcacgcacgcctgaagaatcaatctcgcagctccagcagcggcggcgcctctccggcggcatggccaaggaaggagcaggaggagggcccgactggaacggcctgctcaagtggagcctcgcccacggcagcgacggcaccaacccgccccgcgcgctcagcgaggaggacaggaaatggtttatggaggcgatgcaggcaaatacagtcgatgttgttggcaggatgaaggagattgcccaggtgatgaaaacccctgatgatgtgttgcagtctcatggcgtcactccagagaacattgaagatatgcttgatgagttacaagagcatgtggaatccattgatatggcaaatgatcttcattctatcggtggactagatcctctacttggttacttaaaaaattcacatgctggcatccgagcaaaggcagcagaagttgtgagtacggttgttcagaataacccgaaaagccagcaacttgtcatggaatctaatggactggagccactattgacaaacttcaggtctgatcctagcacgactgcgcgcacaaaagctcttggagctatctcttctctgattcgcaataaccaatctggtcttgctgcatttcgtctaggaaatggacatgctgcactgaaagatgcacttggttctgatgatgctagacttcagagctctgcatctcacacagtacctgctgaacaacaaggcggataggaacgttgctgaaaagattggtcttccgaatcaacttatacacctcgcatccagcgacgattctggagtccgggaggctgccctgggcggccttctagagctggcgcgtgacaagacaccagctgcacgcaacgctctacctgaccaagacaagctgaaagacgtcctgaagagccgaatcgaaggcatcagcgccatggacgcagacgacctgcaagcagcccgtgaggagcggcagctggtggactccctctggaaagagtgctatggcgagccatcttctctaagggagaagggcctcgtggtgctccccggggaggacgcgccgcagcagccgccgccagatgtcgtggggaagatgtttgagccgccactccgtgtgtgggctgtgccgaggcctgctccagcagaggaccccgactctgggagcgggaagaaggacccaccccttctgctaggaccgtgaccgtcttccagctccagttggtagaaccatctcggaagcctggagagcaagcatggtggaaatctagtgattctgcgcgtacaactctgtaacttttatttggttgagtttggcagatgcttgtgttattatcctttgcctcttaagcgacgatctttccacatacttcctccggtcctttttactctgcatattagaatactctgaagtcaaacttcacaaagttgaccgtatttatataaaaatataaacatttgccatgctaaagttatacaatataaactttaagtcagacacattt

SEQ ID NO: 1862 - DNA, 1477 bp, Triticum aestivum
  misc_feature (1466)..(1466): n is a, c, g, or t
tcgacccacgcgtccggcaggtggcgcggcagcgcacgcctcgaggcagatcgttcacgcagcgccggcagcagcgtctctccggcgacagccgtgaggccatggccaaggatggggcaggaggcgggcccgactggaacggcctgctcaagtggagcctcgcccacggcagcgacggcaccaacccgccccgcgcgctcagtgaggaggacaggaaatggtttatggaggcgatgcaggcaaatacagtcgatgttgtcggcaggatgaaggagatcgcccaggtgatgaaaacccctgatgatgtgttgcaatctcatggtgtcactccagagaacattgaagatatgcttgatgagttacaagagcatgtggaatccattgatatggcaaatgatcttcattctattggtggactagatcctctgcttggttacttgaaaaattcaaatgctggcatccgagcaaaggcagcagaagttgtcagtacggttgtccagaataacccgaaaagccagcaacttgtcatggaatctaatggactggagccactattgacaaacttcaggtctgatcctagcacgactgcacgcacaaaagctcttggagctatctcttctctgattcgcaataaccagtccggtcttgctgcatttcgtctaggaaatggacatgctgcactgaaagatgcacttggttctgatgatgctagacttcagaggaaagctctgcatctcacacagtacctgctgaacaataaggcggataggaacgtcgctgcagagattggtcttccgaatcaactgatacacctcgcatccagtgacgattctggagtccgggaggctgccctgggcggccttcttgagctggcacgcgacaagacaccagctgccagcaacgctctacctgatcaggacaagctgaaagacgtcctgaagagccgaatcgaaggcatcagcgcaatggacgccgacgacctccaagcagcccgtgaggagcggcaactggtggactccctctggaaggagtgctacggcgagccgtcgtctctcagggagaagggcctggtggtgctcccgggggaggacgcgccgcagcagccgccgccggacgtcgcggggaagatgttcgagccgccgctccgctcgtgggccgcgccgaggcctgctccagcggaggactccgattcgggcagcgggaagaaggatccgcccctgctgctagggccgtgaccgtctccggctctagttcttggtggaacccagcggatattgtgggaggctgaagagcatgcgttaatggtagaaaagtctagtgattctgcctttagtaacctttattatttgccacaatggttgtactacgctgatcagctgagaggttgattcgagtgttttctttttgcgagtttgacagatgcttgtgttattatcctttgcctcttaagcaatgatcttaatgcncaaaaaaaaaa

SEQ ID NO: 1863 - DNA, 1641 bp, Oryza sativa
atgacgacaaagacctttgtgctgttcccgtcgctgggcgtcggccacctgaaccccatggtggagctagccaagcacctgcgccgccgcggcctcggcgtcatcgtcgcggtgatcgatccgcccaacaacgacgccatgtcggccgacgcgatggcgcgcctcgccgcgggcaacccttccgtcacgttccgcatcctgccggcgccggccagcccggaccccggcgcgcaccatgtcaagcgcaacctcgacacgctccggctcgccaaccccgtgctccgcgagttcctccgctcgctgcccgccgtcgacgcactcctgctcgacatgttctgcgtcgacgcgctcgacgtcgcggccgagctcgccatccccgcctacttcttctttccctccccggccagcgtcctcgccgtcttttcccacctcccgtattactaccgcaacgcgccgtcgttgagggagatggataaggcggcgctcatccgatttcccggcattccgccgatccgcaacgtcgacatgctggcgacggtgaaggacaaggagagcgagacgaccaagatcaggttgtaccagttcaagcggatgatggaagggaagggcgtgctggtgaacagcttcgactggctggagcccaaggctctgaaagcgctcgccgccggtgtctgcgtgcccaacgagcccaagcagagagtctacttcatcgggccactggtcgacgcccgcaagaaggtagggagcggcgccgagaggcacgcgtgcctcgcgtggcttgacgcccagccgcaacggagcgtcgtgttcctctgcttcggcagccagggcgcgttcccggcggcgcagctgaaggagttagctcatgggctggagagctccggccaccgattcctgtggaccgtgaggagcccaccggaggagcagtccacatcaccggagccggacctggagcggctgcttccggcggggttcttggagaggacgaagggcagaggcatggtggtcaagaactgggtgccacaggcggaggtggtgcagcacgaggcggtaggcgcgttcgtgacgcactgcgggtggaactcgacgctggaggcgatcatgtcggcgctgccgatgatatgctggccgctgtacgcggagcaggcgatgaacaaggtgatcatggtggaggaaatgaagatcgccgtgtcgcttgacgggtacgaggaaggagggttggtgaaggccgaggaagtggaggctaaggtgaggctggtgatggaggccgaggaagggaggaagctcagggagaggctggtggagacgagggacatggcgttagatgccatcaaggaggctgggtcttctgaagtggcatttgatgagttcatgagagatttggagaagagcagcttggagaatggagttcgcagctgatcaagcagagtatgggtcatgactgcattagtgtaccaatggcgtcagttaccacatgaaatgtttgcgatttttgttaagttagaagcaaagttgtccgcatagcgatgtttttttcgtcctccgatgacggacgcaattgtctcccgtgtccaaaagttgcagtgtcaaccatttctgtataagcaaattaaaataatgcatagtcttcaaacctgacca

SEQ ID NO: 1864 - DNA, 1616 bp, Oryza sativa
ctagccatgaagagaaagacgtttgtgctgttcccgtcgctgggcgtcggacacctgaaccccatggtggagctggccaagcacctgcaccgccaaggcctcggcgtcgtcgtcgcggtgatcgacccacgcgacgatgatgccacgtcggccgacgcgacggcgcgcctcgccgcggccaacccttccgtcacgttccgcatcctgccggcgccggccacggccagcccggaccccggcccgcaccgtgtcaggcgcagcctcgacacgctccggctcgccaacccggtgctcctggagttcctccgctcgctgccggccgctgtcgacgcgctcctgctcgacatgttctgcgtcgacgcgctcgacgtcgcggccgagctcgccatccccgcatacttcttcttcccctccccggcaagcgccctcgccgtcttcctccacctcccgcattactacgccaacgggacgtcattcagggagatgggacaaggagagcgagacgaccaagatcaggttgtaccagttcaagcggatgatggaagggaagggcgtgctggtgaacagcttcgactggctggagcccaaggccctgaaagcgctcgccgccggtgtctgcgtgcccgacaagcccacgccgagcgtctactgcgtcgggccactggtcgacaccggcaacaaggtagggagcggcgccgagaggcgccatgcgtgcctcgtgtggcttgacgcccagccgcggcggagcgtcgtgttcctctccttcggcagccagggcgcgctcccggcggcgcagctgaaggagatagctcgtgggctcgagagctccggccaccgcttcctgtgggtcgtgaggagcccgccggaggagcaggccacatcaccggagccggacctggagcggctgcttccggcggggttcttggagaggacgaagggcacaggcatggtggccaagaactgggcgccacaggcggaggtggtgcaacacgaggcggtcggcgtgttcgtcacgcactgcgggtggaactcgacgctggaggcgatcatgtcggcgctgccgatgatatgctggccgctgtacgcggagcaggcgatgaacaaggtgatcatggtggaggagatgaagatcgccgtgccgctcgacggctacgaggaaggagggttggtgaaggccgaggaagtggaggcgaaggtgaggctggtgatggagaccgaggaagggaggaagctcagggagaagctggtggagacgagggacatggcgttggatgccgtcaaggaaggtgggtcttctgaagtggcatttgatgagttcatgagagatttggagaagagcagcttggagaatggcgtttgtagctgatcaagcagagttacgctcatgaccgaatagaaatggtgatggtttcttgattccatttttttttttaaagttggcgtaactgaggactctgcataactgtattggtgcatcaatgcgtagctgatgggtgggggctaacagaaaggaaaaatttcaaaaaccaccccaaatatcactctaagtttaagatgcccccctataagaagatttgttgcaaattcccacctcctaattcaccttattttgattt

SEQ ID NO: 1865 - DNA, 2130 bp, Sorghum bicolor
gatgtgacggagaatcttgaaaactttttgctttttggatgaactaaacaaggcccaagtggcggctcaagaaaccagagggaggagtgcacacaactacacaagggggtgattgggcgaaggcgccgaggaagccgagcccctttggattccctgactcgcatggtatctggtcagaaaggcacagactttagtgtgcctctcgttgttgtaacgcccctgtctctctgctcccgcggaagaggggtgcgagcgccgagggagcgcggggggagagagagacggaggcggggaggagtgatgaagtcaatgccgccgccattgccgcacctctgctcctccgccttcgtcgtcttgctgctcctgctgtgtcgcccgttggtggccaatgggagggccacaccgaccggggcttctccgccttctccggagggcccatcggcggctcagcccgctctgcagcctgcacccgctgccaacggcgccgccgccgtgcttcctgcggccgcggggcctcctcccttaggggtgattgtggtggagagacaccaccacctccgcagggagctcatcgctgccattatcctctcatccgtcgccatcgtcgtgatcaccatcgccgcactgtatgccttcttgctgtggcgacgatcacggcgagccctggtggattccaaggacacccagagcatagataccgcaaggattgcatttgtgccaatgttgaatagcttcaactcatacaagactaccaagaagagtgctgccgcgatgatggattacacatctttggaggcagcaactgaaaaattcagtgagagcaatgtccttggagttggtgggtttgggtctgtgtacaaagccaattttgatgggaggtttgctgctgcggttaagagattggatggtggggctggggcacatgattgcgagaaggaattcgagaatgagctagatttgctcgggaggattcggcatccgaacattgtgtcccttgtgggcttctgtattcatgaggagaaccgtttcattgtttatgagctgatggagaatgggtcgttggattcacaacttcatgggccatcacatggttcagctctgagctggcatattcggatgaagattgctcttgacacggcaaggggattagagtacctgcatgagcactgcaacccaccaattatccatagggatctgaagtcatctaacatacttttagattcagacttcagtgctaagatttcagattttggccttgcagtgattagtgggaatcacagcaaagggaatttaaagctttctgggactatgggctatgtggcccctgagtacttattggatgggaagttgactgagaagagcgatgtatatgcgtttggggtggtacttctagaacttctactgggaaggaaacctgttgagaagacggcacaatctcagtgccaatcaattgttacatgggccatgcctcagctaactgatagatccaaactccctaacataattgaccccatgatcaagaacacaatggatctgaaacacttataccaagttgctgcggtggctgtgctctgtgtgcaaccagagccaagttacaggccactgatcaccgatgtactccattcgcttgtacccctagtgcccatggagcttggaggaacgctgaggatcagcccagaatcaccgtatgctactcagatgcaatctcccatttgagataaatgaaacatggacatgattggattgctgattcagtaaggctcgtccaagtgggttcaaaaatcaaaacccccagataacttatgaagttgagcatgggttattgttccttgcttgcattgccttccatggtgtttgtctgagtgccaatctgaggtgccactacatgtcgagctgtgttggctcagtttttgggtttgtggaggagggctatgtatttccgtggctgtacaaagaagtaaaatgaagccctgcccccccccccccccccttttttttcttatggatctgttatcttttgtatagattaaagattttccacactgtaactcatcagtactgccatcaagaaaaaattttgtactactacttcgtatgcactgtttgaactcaagaccaagggtttttttt

SEQ ID NO: 1866 - DNA, 1951 bp, Sorghum bicolor
gtggatcacgcaccacggacaggtagggtttcggccaccgcagccatggccgacgccacgccgtccatcccgagcgccatcgcctccctccaggcctactccacggccctctccgccttcaccgccgcatggcgtgccgtcgagacccacgcctccagcctcgactccaccctcgccgcccgcctagccggctacaccgagctcgagctgatctgctcggcgatggacggcgccggcctcctcgcgtacctcaccgagcacagggacgagctcaaggagccagcgcgcgccctcgacgccgccctccaggtggcgcccgacccggggcttctggtcctctctgcggccgcgactttctgccgcacgccgccggagaaggccaagaacgacggtagcgtcaaggcgtcctgccgcctgctcatggccttgctcgaccggctgcgcgcgattgggttcaagccgtcgcctgaggcacgcgacgaggccagagctgtcgcggcggactggaagcgaggcaagcggatcgggacggaggtgatgtttaagcaggagacgttcgccttcttgcatctcgtgggagtgtttgggctcgtggaggatgtgggcggtgccggcgaggtgcttgatctagtcgtgtcgatctctggtcgtgagcgcgctgttgaggccttcctcgtccttggcctggacctcgaccagcatatgccaatcctcattcagaaaatggtaaacaaaagcaaacagctagaggcagtcaaattcattcaagctcttaatatagtgcacaaataccctttgttgcctattatgaggtcgtacattgatcatgctgcagttgctggtaagatgatccgcatcaggggagatgatcttgctactcagaatgcagctgatgcaaaagagcgcacacttcttggaacattgcagaagttcattaaggaacagaagctagaagaactgcctatttttgaagaagctaacaagcgaatggcacatttggatcagcaaagtgctgagagaaaaagaactgctgcagcagcggctgcggctgcccaaaaggttagtaagaacattgaggagcagcagaaaaagatacaggagctgatgcagcctgctaagagaccaaggcccgagaatgtggtgcaaggttcattaggccagaatgttaacccagctagaacctctactcaacaatttaagccacagcatagcattcataaagctggagtgtcaaatcagtatcaagctgctttaactcagaatgtactgccagcaatcaatcagatttcgcagctagttgctgggagccatcgtccagttggcatccaaaatcaggccattgctgttccgcctcaatatggtagtggtagcttggcaagttattatggagtgacgtccaccacgccatacaggtccagcactctagctcctggacctggtgctttgaatggtccaagtgcgcaggcatcatcaagatcaaagctctattctggagatcccctcgcggctgtctcccgatcatcagataagaagggatcatcttacaaatattctttgtctagtatgtcaacttatgatcataaatgaagatttgttttgtctgcctctggacgaacctgacaaaccttgaaagtttgggtttcagaccgagctctggtcccctttgtaaatgccaagtcattgtagctaacaaaggtccttttacaatataaaggatgtgggtttttatctagaagagattctcctatggagtccgataaatattgtaggaattctaacatatcttccgtccatatgggcacattctcttttattcaatctgaatctgattcatatgccttttcttgtggtatacgggaatggttgtttcagtctctgcagtttacgttttgaggttcttcccctgcacttgtatgcagaaggtcatataatttttttcctggttattccc

SEQ ID NO: 1867 - DNA, 1267 bp, Saccharum officinarum
aaaaaaccaaaaccctcgcgaagttgtgagatccatctagacgcatcgccactcaaaccctaggttgacggatcgctccatggcgatcatctccgacttcaaggaggacgaggctccgcagcaggcggcggcggccggccccggtgtcgaggagtccctggtggcggcgctggagaggagcggcggcgcgctccccttcctccaggcggccatcgatgtcgcccaccgcaggtccggcttgttccgcgacccttcggcggtgagcaaggtcaccgcgatggcggcggccgtcagggcgcaggtggaggccgaggagagggcggctagggaggccaagaggaaggcggaggaggccgagaggaaggcggcggccgaggcgcagaaggctgccgccgaggcggcggcgacggcgacggcggaggagaagccagagagctcggtggagaaggacagcatggaggtggataagaaggaggaaggcaacgtgagacaaccaaatgctggcaatggtcttgatttggagaagtacttgtggactcaacagctgccagaggttaacatcaccattcctgttcctcaaggaacaaaatcaagattcgtggtctttgatataaagaagaaccatctgaaggttggtctgaagggccagccacctatcattgatggcgagctctataagccagttaaggttgatgactgcttctggagcatagaggatggaaaaactctgtccatattgcttacaaagcacaaccaaatggagtggtggaagtctgttataaagggtgaccctgaagttgatacccaaaaggtggaacctgagagcagcaaactctctgatttggatcctgagactagacaaaccgtggagaagatgatgtttgaccagcgccagaagcagatgggccttccaacaagtgatgaaatgcaaaagcaagaaattctcaagaagttcatgtctgagcacccggagatggacttctctagagcgaaattagcttgaggatttgttcgggcagttatttctaccagtctgcattaggttgtctttgagtgcgttattagtgtgaaacaaattttgatcagttcttctgtaatgcgtcagaaatatcatttagaactgtgacatgtgtcttgaaccaacctaatggctggattatgtcaattttttagctctccgtgctacttgctatgcttgttaaatgaacttccactgttgtagcgtgctcacgataaaataaaactaaagaattctgtttgttggctt

SEQ ID NO: 1868 - DNA, 1151 bp, Sorghum bicolor
aaatttcgaaggagtccaattttctttcaaatttcaacccgcatccgcgaatctctcgctttcccaatctcgccccctctccaggcgttaacccttgcggcgatttggtgcgcagctccgcgtgagagctacgggcacgccgcgatggacttcgagtacgtccccgcgtcccccggcagcagcaggtgggcgggcgagtcagcggcgcggcggcggcagcgccgactctcttcgccgtcgttgaggacctacctcacgccggcctttgacgccgtggccggtggggacggcggcgtgtctgggtacacttcatcgtcgtcttccggcggtctcgaactcgggttcgacgcctcgctcctccgctaccgccgctcctgcttcgccgcctccgcggacctcgacagccgcgtcctcctctactccccgcagtcggcgccgccgccgccgcagatgagggcggggtacctggtagcggatgatggggtttgggcacctggcggtggccactacggctccaaacatgaggctgggcggcttactggcgcaccaggttttcaggattcagaaaaccgcatttcttttgtctccgcgccacagacaagtagcaatcttcctactacagttctcggcgcctccaccttggccaagcttcctgctgaactccagttgccagagggcagcatcgtagcgaccaatgcagagctcccaacgccaggaccagacgctacgccttcagctctcaagtcatctgctgatccagaaccttcagtggagggcgatgaaatcattgaagctctctacggtgacagtggtcgtcgcaggctgcccattttcagggagatctgtccagaatgagtgtcagcctcagcatgctgaacattgctgatggatgcatttcggctctagctgtatattctgtttatctatcttgtacccatagtcttggtagctggaggattatttctagtttgctaaaggagaatctctcttctattgatctcttcattaagtgagaaagctatgatatacattacttgagtaagccggcaattggcccgttttgcttgccgttggttggaggtgaaccttagcatatatatgaatttagcctttttttggccctgtggaactgagatgcaggttttccatac

SEQ ID NO: 1869 - DNA, 1328 bp, Hordeum vulgare
ccgtggaaccctcctcaatccgtttttgtttcctagatccgcgtggaggcggcgagaggccgagtccgtcaggactcaggagggcgcgcgcgcccccgccgtcaaaatccaatcttggcggcggctggctccgcgtggtcttcttcttcttcttcttcttcccgcgtcctgttgcgggcgataagggaaagaggaggaggaggaggaggaggaggatggtgccgtgggaaggctacgcgagcgacgagacgatgggcaccttcgcccccatcctgctctactgggtctacgccggcggctaccagctcgtcctgcaccgccgcccgctccagcgctacaggctccacacaagggcagaggaggaggacaagaacctcgtcaccctccccgcggtcgtgcgtggggtgctcctgcagcagctcgtgcaggccatcgtcggcatgatcctcttcatgattacttcagatagttcaactgttctagtccaaccatctatggtggttcagtcgtttcagttcttggttgcaatgctggtgatggacacctggcaatattttgtgcaccgctacatgcatcagaacaaattcctctaccgacatatccactcacaacatcaccggctgatcgttccttacgctatcggggctctctacaaccacccactggaggggctccttctggacactttaggtggtgctatgtccttcttggtctccggtatgacgccgaggactgccgtattcttcttctgtttcgctgtgctcaagacggtcgatgatcactgcggactttggttgccatataacatcttccagcacctgttccaaaataacacggcataccatgatatccaccaccagctccaaggcacgaagtacaattactctcagccgttcttctccatatgggacagaatcctaggaacccacatggcctacgacctagtgagccgcaaggaagggggtctcgaagccaggccattgcgagactagcttggaactcatcgaagtgtatagaactccggcgactcagcgggatatacgatgctgtttcactccccatcgtgtgattggtagctcacaggagccatctaacttcttgtaagatgatgaaggtattccagtactcccggtttcttgtgcaaagccgccgtttaattacatcgctgtgcagatagtgtattcgaaaatcagtcacgcttctgtatgtatccaatttatttatgtagttgaatctttgggcatgactatgacattcagacgcgtatttggctaccactgtatagtttctacctgattaatcacatatcaatcagctttgatggtatt

SEQ ID NO: 1870 - DNA, 1393 bp, Brachypodium distachyon
cgcgagaatccaatctcggcgggtggctgcgcgtcttctgctttcttgttcctcttcctgcgtgctgttgcgggagagataaggaggggttgggatggtgccgtgggaagggtacgtgagcgacgagacgatgggcaccttcgcgcccatcgtgctctactgggtgtacgccggcggctaccagctggtgctgcaccggcggccgctggagcggtacaggctccacacgctggccgaggaggacgagaagaacctcgtcaccctccccgccgtcgtccgcggcgtgctcctgcagcagctcgtgcaggccatcgttgccatgttcctcttcatgattacttcagatagctcaacggttatagtccagccatctatggtcgttcaaatgtttcagtttttggtagcaatgctggtgatggacacatggcaatattttgtgcaccgctacatgcaccagaacaaattcctctatcgacatatccactcacaacatcaccggctaattgttccttatgctatcggggctctctacaaccacccattggaggggctccttttggacactttaggtggtgctatgtccttcctggtctctggtatgacaccgagaactgctgtatttttcttctgctttgccgtactcaagacggtcgatgatcactgtggactttggttaccatacaacatcttccagcgcttgttccaaaataacacagcctatcatgatatccaccatcagctccaaggcacaaaatacaactactcccagccattcttctcaatctgggacaaaattctaggaacccacatggcctacagtctagtcagccggaaggaggggggattcgaagcaagagcatcacgggactagattgaactcattcatgtgtacaaaactccagccactaagtggagatatacatggcagctcacagggagcatctaacttgtaagatgatggaggtattccagtactcccggtacccccttttttcgcgtcttggtggaagccattcgctctttgagaagacactggatctgtcgcattgcatgtttattttttcctacagttggagcgttcgtctcgaatgtgcgtggttctgtatggtttagctggttactctcgagtcttgatggttctttcttgtgcaaagctggcatttacattgctgtgcagatagtgtatttcaggaatcaatcacacttctgtatgtaccaattatatttgtgtaaccgaatctgtctctgggcatgaccattaccttcaaagttcaaaccaacattcggctactgctgtatagttttttgtgttgtcaattacatatcagctttgtcggatggtattcattctctaaaattctttgagatgtaacctggataagaatccagatcc

SEQ ID NO: 1871 - DNA, 1781 bp, Oryza sativa
aacaaggaatatccgcaagcaataaaggggaaggaggtgagatgaagccctaccttttgattgggatttgctcttgaatctgcttccaaaccatcgattcatcatccatctcttccagtcttccttcgcattctcctggaaaaaaatcagaaaagaaaaaggaaaaatctcttgtactctcctcgattctgcaatttttgtttggttgtcccaacaaaaatcccccaattctccccaagaacaggagcacacgaccctgttcctgtcccctagatctgcgtggaggcggcgagaaaacctcaatccggcacaaggggcttgtggttgataccccggagcgccgtctaattccaatcttggtagctgccggcggtgcttccggtggtagacgaggagatggtgccgtgggaagggtatgtgagcgacgagacgatggggacgttcgcgcccatcgcgctgtactgggtgtacgccggcggctaccagctggtgctgcaccggcggccgctggagcggtacaggctccacacgcgggcggaggaggaggagaagaacctcgtcgccctccccgccgtcgtccgcggcgtgctcctgcagcagctcgtgcaggccatcgtcgccatgatcctcttcatggttacttcagatagttcagcagttgtagttcagccacctatcatcattcaagctttccagtttttggttgcaatgcttgtcatggattcatggcagtattttgtgcaccgctacatgcaccagaacaaattcctctatcggcatatccattcacaacatcatcggctgatagttccctacgccattggggctctctacaaccatccattggagggactccttctggacaccgtgggtggtgctatctccttcttggtctctggcatgacaccaaggacttccgtgttcttcttctgttttgctgtcctcaagacagttgatgatcactgtggactttggttaccgtataacatcttccagtccttgttccaaaacaatactgcctatcatgatgtccaccatcagcttcaaggctcaaagtacaattactctcagccttttttctcaatctgggacagaatactggggacccacatgccctacaacttagtaagacggaaggaaggcggttttgaagcaagaccactgcgagactagcttgaaccgatggaagtgtatagaactccagcaactcagtgagatacaatgctctacctccctttcatatgtttagaacctcatagggaccaatctaacttcgaagatgttgaagctgttcaagtactcccagattttctttttcgcgtcttgctggaagcaatacgctagtcgggatttgggaagacactgaagctcttgcgcgatgcttgttcttacacctgctgttaatctagttagatcggtcacctggaatgtgtgtggtactgtatggtttgtcttgatggcttttctccttgtcatggctattttttgtgcagagctggcatttacattgctgtgcagatagtgtatttggaatcacacttctgtatgtacccccaattatttatgtaactgaatatctgggcatggttggtaacttcaaagttcaaaccaatctttatctactactgtatagtagtttgtttgatcaattacagatcaactttgatggtactcatgtttccatttctaagtgtagcttttacagctgttgaaaaccaaagacctcctgaagcttaagcttgcatgttgggttacatattggttgatctggagttcatttc

SEQ ID NO: 1872 - DNA, 1968 bp, Sorghum bicolor
ctctaagaactggaaaaactaagccatttgtaattctccactgtactagtcgttggcgaggtctgtttcatgtttcttactttgtttatttattagggaaagaaatccctgatcaatagagatggatccacatgcaataaatcttctgttctggcaccttcccaaatcaataagggcgaggcgacagcagcgaggagacgaagcccttaaaggcgccagcttttcttctgttccatttggtctcctcttgattcctctttaaacgatttcatcttctgcacatcatcagctcatcagctgatcctttccgtcgtatttccgagcaaaagagaaaccctttttatgcgctgtgctgttttgccatctctgttcgtcccaccgactcgaatccccattctccccaaccgagtggcctctggcgtcacaaaacaagaacacgaccggttcctattccctagatctgcgtagaggcggcgagacacccgaatccggcaaaagggttcgctgtttgattgggaaaagcgcaggagtccggcgtcaaaacccaatcttggcgccggagcagccgtgcgccatcatcttctccgtgtgttgttagggagaggagaagaccagtggagatggtgccgtgggaagggtacatcagcgacgagacgatgggcaccttcgcgcccatcgtgctctactgggtgtatgccggcggctaccagcttatccttcaccgccggccgcttgagcggtacaggctccacacgcgggccgaggaggaggagaagaacctcgtcagtctccccaccgtcgtccgcggcgtactcctgcagcagcttgtgcaggccatcgtcgcgatgatcttgttcatggtcacttctgatagctcaataactgttgttcagccacctattgtcgtccagatctttcagtttttaattgcaatgctagtgatggactcatggcaatactttgtgcaccgctacatgcaccaaaataaattcttatatcggcacatccactcgcaacatcatagactgattgttccttatgctattggagctctgtacaaccatccattggagggcctacttttggataccttaggaggtgccatctccttcttggtctccggtatgacgccaaggactgctgtgttcttcttctgtttcgccgtcctcaagacagtcgatgatcactgtgggctttggttaccatataacatcttccagcacctgttccaaaataatactgcctatcacgacatccaccaccagctgcaaggaaccaaatacaactactcccagcccttcttctcaatctgggacagaatactaggaacccacatgccatacgacttagtgagcaggaaagaaggtggatttgaagcaagaccattgcgagactagcttgaagtcatggaagtgtatagactccggtgaatgagtcagaatacggtgcttagcctccctttcacatgattaggagctcccaacaggggccatctaatttacttccaagatgatgaaggtgttctggcaattggtggcttagtctacatcttggttgagtctacacgctacttaagcagaggtcgaagctcatgcattgcttgctcttttgagtgcggtctatatggtctgcgcgttcaactggttgtacgaatggttttacctgtcatggttacttttttgtgcagagctgccatttacattgctgtgcagatagtgtatttgaaaatccacacttctgtatgtacccaattatttgtgtaattgaacctggtcgtgatcgacaccttcggcgctatctttggctactactgactgtatagttgtattagatccactacgggtaaactttcacttgttctgatgtatccttcactttcacctcttgaaacacagttgcgtgataattcagataatctcgacgatctgtatagtatggttcttttaacaaatatatggttcgatggat

SEQ ID NO: 1873 - DNA, 1508 bp, Saccharum officinarum
  misc_feature (492)..(492): n is a, c, g, or t
  misc_feature (497)..(497): n is a, c, g, or t
  misc_feature (506)..(507): n is a, c, g, or t
  misc_feature (511)..(511): n is a, c, g, or t
  misc_feature (531)..(531): n is a, c, g, or t
  misc_feature (535)..(535): n is a, c, g, or t
  misc_feature (552)..(553): n is a, c, g, or t
  misc_feature (556)..(557): n is a, c, g, or t
  misc_feature (562)..(563): n is a, c, g, or t
  misc_feature (566)..(566): n is a, c, g, or t
  misc_feature (572)..(572): n is a, c, g, or t
  misc_feature (575)..(575): n is a, c, g, or t
  misc_feature (581)..(581): n is a, c, g, or t
  misc_feature (586)..(586): n is a, c, g, or t
  misc_feature (743)..(743): n is a, c, g, or t
  misc_feature (825)..(825): n is a, c, g, or t
  misc_feature (925)..(926): n is a, c, g, or t
  misc_feature (1005)..(1005): n is a, c, g, or t
  misc_feature (1007)..(1007): n is a, c, g, or t
cgacgacagcgaggagacgaagcccttaaaggcgccagcttttcttatgttccatttggtgacctcctgaaccctctttaaacgatttcatcttctgcgcatcatcagctaacccttcttacgcgctctgctgttctgccatgtgtgtgcttaccaccgactcgaatccccattctccccaaccgaggggcctctggcttcacaaaacaagaacacgacgggttcctgttccctagatctgcgtagaggcggcgagacacccgaatccggcaaaagggttcgcggtttgattgggaggagcgcaggaatccggcgtcaaaacccaatcttggcgcccgtgcttgagtgccccatcgtcttcttcctgtggtggtaggaagaggcgataggaagaggcgaacaccagtggagatggtgccgtgggaagggtacatcagcgacgagacgatgggcaccttcgcgcccatcgtgctctactgggtgtatgccggnggctnccagctganncttnaccgccggcgcttgagcggnacangctccacacgcggaccnnggnngaggnnaanaacctngtnagcctncccancgtcgtccgcggcgtactcctgcagcagctcgtgcaggccatcgtcgcgatgatcttgttcatggtcacttctgatagctcaataactgttgttcagccacctatcgtcatccagatatttcagtttttaattgcaatgttagtgatggactcatgncaatactttgtgcaccgctacatgcaccaaaataagttcctatatcggcacatccactcacaacatcatcggctgattgttncttatgctattggggctctgtacaaccatccattggagggcctacttttggacaccttaggaggcgccatctccttcttggtctccggtatacaccaagnnccactgtgttcttcttctgtttcgccgtcctcaagacagtcgacgatcactgtgggctttggttaccatataacatctncnagcacctgttccaaaataacactgcctatcacgacatccaccaccagctgcaaggaaccaaatacaactactctcagcccttcttctcaatctgggacagaatactaggaacccacatgccatacgacttagtgagcaggaaagaaggtggatttgaagcaagaccgttgcgagactagcttgaagttatggcaagtgtatagactccggtgaatgagtcagaatacggtgcttagcctccctttcacatgattaggagctcccaacaggggccatctaatttacttccaagatgatgaaggtgttccggcaattggtcgcttagtctacatcttggttgagtctacacgctacttaagcagagatcgaagctcatgcattgcttgctcttttgagtgcggtctatatggtctgcgcgttcaactggttgtactcatatgcagcttcatccctacttagggcatttgggctgacaaacacacacaccctagtcgtatactc

SEQ ID NO: 1874 - DNA, 1567 bp, Panicum virgatum
ttaaaggcgtctgctttccttccattccatttggtttcttgatttctctgtagaaaaaacacacatctcagctgatccttccgagaaaaacataaatctttttcgtgccctctgctatttcgccatttctgttcgtcccatcagacaaaatccccatctcccccaaccggttgtgccgtgtgcgtcactgaacaagaacacgtccggttcctgttccctagatctgcgtggaggcggcgtggagcctgaatccggcaaaagggttcgcggttggttggccggagcgcccgagcccgccgtcaaaacccaatcttagcgcccgaccggccgtgcgccgccgccgtcttcctgcggtgacaaggagcaggcaaggtcggcggagatggtgccgtgggaagggtacttgagcgacgagacgatgggcaccttcgcgcccatcgtgctctactgggtgtacgccggcggctaccagcttatcctgcaccgccggccgctcgagcggtacaggctccacacgcgggctgaggaggagaagaacctcgtcagcctccccgccgtcgtccgcggcgtgctgctgcagcagctcgtgcaggccatcgtcgcgatgatcctgttcatggtcacatcagatagctcagtaactgtagttcagccacctattgtcgttcagatctttcagtttttaattgcaatgctcgtgatggattcatggcaatattttgtgcatcgctacatgcaccaaaacaaattcctttatcggcacatccactctcaacatcatcggctcattgttccttatgctattggggctctctacaaccatccattggaggggctgcttttggacaccttaggtggtgccatctccttcttggtatccggtatgacaccaagaacagctgtgttctttttctgttttgctgtcctcaagacagttgacgatcactgtggactttggttaccgcataacatcttccagaacctgtttcaaaataatactgcctatcatgatatccaccatcaactccaaggcacaaaatacaattactcccagcccttcttctcgatctgggacagaatactggggacccacatgccgtacaacttagtcagcaggaaggaaggtggatttgaagcaagaccgttgcgagactagcttgtgctcaatgcaagtgtacagatctccagtgaaagattgagatacaatggtcagcctccccttcacatgattagaagctcacaggggcccatctacttctaaaacgatgaactgtgccggtgctgcttttggcatctctgtccaagccaagttacttgggaatggactgaagctcctgcatcgcttgttctcctgcagttcatctagatgggagggtccatttcgaagtctgaatgtgtgatacggtggtttgtatgcatggtacctgttatggttctttttcttctttttgtgcagagcttccattacattgctgtgcagatagtgtatttgaaaatcacgcttctgtatgtacccaattattcgtgtaattgaattactgggcatgacggatctgacttttactgt

SEQ ID NO: 1875 - DNA, 1476 bp, Triticum aestivum
tcggcgattaaccctctgctaatcatcagtcgatccttcttctctctccgtgtttcctggacggctcctgccctcctcggtcctgccatttccgtttggccccgtcgtcggttctagtcgaatcccccattctgccccgacccgaggcgcgcggcttcgcgggacaagaagaacacggccgcccggcagttcccggttccctagatctgcgtggcggcggcgagaggcagagtccgtcaggagggcggaggaggaggcggccagcccagcaatggtgccgtgggaaggctacgtgagcgacgagaccatgggcaccttcgcgcccatcctgctctactgggtctacgccggcggctaccagctcgtcctgcaccgccgcccgctccagcgctacaggctccacacgcgggcagaggaggaggacaagaacctcgtcaccctccccgccgtcgtgcgcggcgtgctcctgcagcagctcgtgcaggccatcgtcgccatgatcctcttcatgattacttcagatagttcagtggttctagtccagccatctatggtggttcagtcgtttcagttcttggttgcaatgctggtgatggacacatggcaatattttgtgcaccgctacatgcatcagaacaaattcctctaccgacatatccactcacaacatcaccggctgatcgttccttacgctatcggggctctctacaaccacccactggaggggctcctactggacactctaggtggtgctatgtccttcttggtctctggtatgacgccgaggacagctgtattcttcttctgtttcgctgtgctcaagacggtcgatgatcactgtggactttggttgccatataacatattccagcacttgttccaaaataacacggcgtaccatgacatccaccatcagctccagggcacaaagtacaactactctcagccgttcttctcaatatgggacagaatgctaggaacccacatggcctacgacctagtgagccgaaaggaagggggattcgaagcgaggccattgcgagactagcatggaactcattgaagtgtatagaactccagctactcagtgggatatacgatgctcttctagtccccttctcatgattggcagcttacaggagccatctaacttcttgtaagatgatgaaggtattccagtactcccggttcctctttttttgttctcatgccttggtggatgccattgtctactggagaagacactgaagctgttgtgttgcttgttcttttttccctgcagttatctagttagacccgttcaccttgaatgtgcgtgttttgtacgggtagtcggttactcgtgagttttttatggttctttcttgtgcaaagctgccatttacattactgtgcagatagtgtattcgcaatcagtcacgcttctgtatgtatccaattatttatgtaaccgaatctttgggcataaaaaaaaaa

SEQ ID NO: 1876 - DNA, 1333 bp, Brachypodium distachyon
gatactagaaggcagcagagcaaagcaactacctcacgttgagccggtgagcgatcccagcacgccacgagggggattcagatggcaggcgggggatcgccgtcggacgcggaggcggagctccggcagggcttcaagacgcttgccgtgacgcggccggacccctcggcggcggtctacgaggtgcgcctcaaccgcccggcccagcggaacgcgctcagcccggactccttcgcggagatcccgcgcgccatggcgctcctcgaccgcctccccgcggcgcgcgccgtcgtgctctccgcctcgggcccccacttctgcgcgggcatcgagctcggcgggcccgggaacccgctcaccgcctccttctcccgcggcgccgaccccgtggccgccgccgaggggctccgccgcgcgatcctggatatgcaggcggcgatgaccgccgtcgagctgtgccggaagcccgtcatcgccgcggtgcacggcgcctgcgtcggcggcggcgtcgacctcgtagccgcctgcgacgtgcgctactgctccaaggacgccacgttcgtgctcaaggaggtggacatggccatcgtcgccgacctcggcgcgctgcagcggctgccgcggatcgtcggctacgggaacgccgcggagctcgcgctcacgggccgcaggatcaccgccgtggaggccaaggagatgggcctcgtcagcagggtgtttgattccaaacaagagatggatgccgctgttgcaaagatcgcaaaagatatatctgagaagtcggcatgggcagtgatgggaacaaaggctgtactgctgagaagcagggatataacaatagagcagggcctggagcatgtagcgacctggaacgccgggatgatgagatctagcgacctgatggaggccattaaagctttcctggagaagcgtaagccggtgttctccaagctgtaatgatcaaatataccaatgcttcacaaccgaaatcctagccacttgagaatatcagaataaagtgaggtgatagaatgtagataatacaatctatgaattggcaaaacaagagttcttgccaatagtgcttacatttgctgggaactgagttgaactgggagatatttccattatgacttcaaatactacctccgaacaacaaaggatgtctcaactttgattaagtttgaatgtatctatacactaagtcatgtttagatacattcaaattttgacaaacttgagacatattttgttggacggagggagtaattctctgctatagttacttgttgtatgtatatcatagatgattttctgagatttctcatcactg

SEQ ID NO: 1877 - DNA, 1593 bp, Zea mays
aggagcgatataagtcagaagatgattatccctatccgcctccgcttaccttagatgtctccgagatccaaaaacaagaacaagagcgagcagagcgtggcgacaaatcacccgctgccttttatcccgcaaccagcagcagcgaaggccgcgagaggcaggtagtagccgcacgccacatcaacccaccacggatggccggcggcggcgaccgtgacgcatccgacgcggagctccgcgcggggttcgagaccctggccgtgacgcggccggacccttccgcgggggtctacgaggtccgcctcaaccgcccggcgcagcgcaacgcgctgagcccggccgcgttcgcggagatcccgcgcgccatgtctctgctggaccgcgccccctcggcgcgcgccgtggtgctgtccgccgcgggcccgcacttctgcgcgggcatcgagctcgggggccccggggacccgctgtccgccgcctccgccgatcccgtggccgccgcggaggggctccgccgcgcggtcctcgacatgcaggcggcgctcacggccatcgagcggtgccggaagcccgtcgtcgcggcggtgcacggcgcctgcgtcggcggcggcgtcgacctcgtggccgcctgcgacatcaggtgctgctccagggacgcctccttcgtgctcaaggaggtggacatggccatcgtcgccgacctcggcgcgctgcagcgcctcccgcggatcgtcggctacggcaacgctgctgacctcgcgctcaccggacgcaagatcaacgccatggaggccaaggacatggggttggttaccagggtctttgattccaagcaagacttggatgcgggcgtcgcaaagatcgccaaagaaatagctgacaagtcggcatgggcggtgattggaaccaaggccgttctgctgagaagcagggatgcgaccatagaacaaggcctggagcatgtagccacatggaacgcgggtatgatgaggtcgaacgatctgaaggaggccatcagagccttcctggagaagcggaagcctgtgttctccaagctgtaatgatcagataccatcataccatacctctgtgttacttaacaagtggtgctacgtatctggaaatgcaaaggaataaagtgtgctaggagtagacaattgtcagggaaaaagaaaaaaaaaatgcctgttctcgatggagctgtgaaggcatttttccatgtcagttgagcttaccaaagttgttttggtcggtatggatgaaccgggggtgttactgttttgttacctgttccagtctgtacgtagattcatctcttctgcaccgagacaaaatgccaaacaatcatctggagttcaaagtcatctggggctttgagcgaactgggacattcactacagtctgtggtgcacaagaaatgaatctgcgtacaaactggaacaggtaacaaaaccgtacaaactggaataggtactcaaaacagtactctctgtcctgaattagattcatatatatatgaataatttatctagaaacaaatctatctctatcaattttacaaggttaaatggtccaccaaacaatttatttttc

SEQ ID NO: 1878 - DNA, 1393 bp, Sorghum bicolor
gatgattatccctatccgtcgccgcttatcttaggaatctccgagatccaaaaacaagaacaagagcgagcagaggtggcgacaaatcacccgcggcttcatatcccgcaaccaccagaaaagggcaggtagcagtgaaccccacgccacagcaacccacacaacacggatggccggcggcaaccgtgacgcatccgacgcggcggcggccgaggcggagctccgggcggggttcgagacactggccgtgacgcgtccggacccttccgcgggggtctacgaggtccgcctcaaccgcccggcgcagcgcaacgcgctgagcccggccgccttcgcggagatcccgcgcgccatgtcgctcctggaccggacccccaccgcgcgcgccgtggtgctgtccgccgcgggcccgcacttctgcgcgggcatcgagctgggcgggcccgggaacccgctggccgccgcctcctcctccgccgaccccgtggacgccgcgaaggcgctccgccgcgcggtcctggacatgcaggcggcgctcacggccatcgagcggtgccggaagcccgtcgtcgcggcggtgcacggcgcctgcgtcggcggcggcgtcgacgtcgtcgcggcctgcgacatcaggtgctgctccagggacgccacgttcgtgctcaaggaggtggatatggccatcgtcgctgatctcggcgcgctgcagcgcctcccgcggatcgtcggatacggcaacgctgctgacctcgcgctcaccggacgcaagatcaccgccatggaggccaaggagatgggcctcgttaccagggtcttcgattccaagaaagaattggatgccggcgttgcaaatattgccaaagaaattgctgagaagtcggcatgggcggtgatgggaaccaaggcggttttgctgagaagcagggatgtgactgtagaacaaggcctggagcatgtagccacatggaatgcgggtatgatgagatcgaatgatctgaaggaggccatcaaagccttcctggagaagcggaagcctgttttctccaagctgtaatgatcagattcagataccatgcctctacttaacagtgctacgtatctggaaatgaaaaggaataaagtgtgttacgagtagacaagaataccatctctgtcctctgatagcatttgacgaaacatccattcccgtcagggaaaatacttgttctcgtcggagctgtgaagacatttttccatgtcaattgagcttaccaaagttgtttcggtagatatgtcagatgaaccaggtgttactgttttgttacctggctcaagataattagtcaagaatattatagaatgttccagttcgcccaaatccccagatgacttaactccagatgattgtttgcca

SEQ ID NO: 1879 - DNA, 1153 bp, Triticum aestivum
  misc_feature (49)..(49): n is a, c, g, or t
  misc_feature (58)..(58): n is a, c, g, or t
  misc_feature (174)..(174): n is a, c, g, or t
  misc_feature (197)..(197): n is a, c, g, or t
  misc_feature (387)..(387): n is a, c, g, or t
  misc_feature (415)..(415): n is a, c, g, or t
  misc_feature (566)..(566): n is a, c, g, or t
  misc_feature (575)..(575): n is a, c, g, or t
  misc_feature (672)..(672): n is a, c, g, or t
  misc_feature (675)..(675): n is a, c, g, or t
  misc_feature (684)..(684): n is a, c, g, or t
  misc_feature (753)..(753): n is a, c, g, or t
  misc_feature (992)..(992): n is a, c, g, or t
  misc_feature (1065)..(1065): n is a, c, g, or t
  misc_feature (1070)..(1070): n is a, c, g, or t
  misc_feature (1073)..(1073): n is a, c, g, or t
  misc_feature (1091)..(1091): n is a, c, g, or t
  misc_feature (1093)..(1093): n is a, c, g, or t
  misc_feature (1095)..(1095): n is a, c, g, or t
  misc_feature (1098)..(1098): n is a, c, g, or t
  misc_feature (1102)..(1102): n is a, c, g, or t
  misc_feature (1112)..(1112): n is a, c, g, or t
  misc_feature (1116)..(1116): n is a, c, g, or t
  misc_feature (1133)..(1133): n is a, c, g, or t
  misc_feature (1137)..(1137): n is a, c, g, or t
catattggagatgctcttatagaagctttggataagttcatttttttcngcagcagcngcagtcaacagagcagcacaggcggctagagtttaatccccacacggcatcagatggccggcgcgggctcgtcggacgcggaggcggagctgcggcggggcttcaaggccctggcngtgacgcggccggacccggcggncgcggtctacgaggtgcgcctcagccgcccggcgcagctcaacgcgctcagcccggactccttcgcggagatcccgcgcgccatggcgctgctcgaccgcatccccgccgcgcgcgccgtcgtgctgtccgccgcgggcccccacttctgcgcgggcatcgagctcggcgggcccgggaacccgctcacngcgccccccgcccgcggcgccgaccccncggccatggccgaggggctccgccgcgcgatcctgggcatgcaggccgcgctcaccgccgtcgagctgtgccggaagcccgtcatcgcggccgtgcacggcgcctgcgtcggcggcggcgtcgaactggtggccgcctgcgacatacgctnctgctccanggacgccaccttcgtgctcaaggaggtggacatggccatcgtcgccgacctcggcgcgctgcagcgcctgccgcggatcgtcggctacgggaacgcngcngacctcgcnctcaccggccgcaggatcaccgccgcggaggccaaggagatggggctcgtcagcagggtgttcgattcnaagcaggagctggatgccggtgttgcgaagatagccaaagaaatatcagagaagtcggcaaacgcagtgatgggaacgaaggcagttctactgagaagcagagatatcacagtagagcagggcctggagcatgtagcgacttggaactctggaatgctgagatctaatgacctgatggaggccatcaaagctttcatggagaagcggaagcctgttttctctaagctctgatgatcaanatcacaggcgagaatttatatgtgaatcctagccacttgagaataaaatgagatggtagaaattagacaaganatacnatntctgaattggaaaacaangntnttnttgnttgtatcttntatntatatcatatataaagngagnatttctgaaaaaaaaa

SEQ ID NO: 1880 - DNA, 861 bp, Oryza sativa
atggaggaccttggaacagtagattcccattgtcatgctgccactaatctgattgtgtcacttgtgcgattgatggagttcaccttccatcttatgcacctaatcttatattcagacaagagagaagctccactcttctccaccccaagagaattgaagccaagcatggagaatggaggggaagaagatgacagagcaagccgatgcaagaggattaccagagaatcagatgcaaccaagaatggtgcagcgaccaagctgcaagctttgaggctcgtcgaggacctctccctcccttctgtgcaggtggtggtgatgagcgccaacatgggctgttcgcactgccgacagcgggtcacaaaggttgtctccaagatgaacgggttgctagattacatggtggattttgggaagaaggaggtgacagtgagagggacgatggtgcacaccaagaagaagaggaagcaacacaagaagaagcatgaggaaaacaagaagggaatcgctgcaaactgggagaagaaatcgtcttctcagagcaatgacagcgccaggacgctggcctggtttctacgatgctacagttcatagcaactactactatctagtgcatactatagtctacatatagtgttacttatatactactaatatatatagatatatctagaagctatatagctgctcgattaattgtttatttttctctttagtttcttcttgcaatttctttctttctcatgttttattatttttctttttgattgaaaataacgtatgatggtaggaaatgtgtatattctgcccataactgtgcattataaaatcctctatttgcaaggtaacatacaaaacaagaaa

SEQ ID NO: 1881 - DNA, 580 bp, Zea mays
ctaagctgactcaaacgcagccacacaacaccatctcctcagtacatcagagcctcccagttagcaatatggcaaagtatctcgccgtcgcgctcctgctactggtggtgctcgcgtactgcgacgggagggagctgaaccagaaggaccaggcactcgcaacggcacgcggtgctggtgcgggtgctggtggtggcgtcggcgaggagaagattttggggttggcagagttgccgcttgtgggaactgttaccggtaccagcacagttaccggtccggtggtggtggttcctgcccttcccgggatccctgctcacccatgatcatcaccagttcatatgctgtcttacaagatgaagctgaactagtgggtttatgacttctagctagcaccgtccggaagataaacaccggtgtttcgctcattttcacgttccttcatgagcgtctgtatcaactatcctatcgtctgtattttctttcagttcatgttctagtattttccgttcctctgtattttctttcagttcatgttctagtatgatgtatcgtcaacctaataaatactactttgtcatct

SEQ ID NO: 1882 - DNA, 525 bp, Secale cereale
cacaataccatctcctcagtacatcagagcctcccagttagcaatatggcaaagtgtctcgccgccgcgctcctgctactggtggtgctcgcgtactgcgacgggagggagctgaaccagaaggaccaggcactagcaacggcacgcggtgccggtggtggcgtcggcgaggagaagattttggggttgccagagttgccgcttgtgggaaccgttacagggaccagtaccgttaccggccctgtggtggtgcttcctgcccttcctgcactaccggcacacccatgatcatctcgagattatgtgctggcttacaagatgaagctgaacttgtggcttcagaattctagctagaaccgtcagctcgggaagataaacaccggcgtttcgctcattagcatgttccttaatgagcgtctgtatcaactatgctatcgtctgtattttctttccgttcatgttctagtatttcccattcatctgtattttctttcagttcatgctctagtatgatgtatcgtcaac

SEQ ID NO: 1883 - DNA, 643 bp, Triticum aestivum
  misc_feature (635)..(635): n is a, c, g, or t
caaacgcagccacacaactctgtctcagtacattagagcctcccagttagcaatatggcaaagtgtctcgccgccgcgctcctgctactggtggtgctcgcgtactgcgacgggagggagctgaaccagaaggaccaggcactagcaacggcacgcggtgctggtgccggtgccggtgccggtggtggcgtcggcgaggagaaggttttggggttgccagagttgccgcttgtgggaaccgttaccggtaccagcacagttaccggtccggtggtggtggttcctgcccttcccgggatccctgcacacccatgatcatctccacttcatgtgctggcttacaagctgaagctgaacttgtaggcttatgacttctaggtagcaccgtccgtaagataaacgccggcctgaccggcgtttcgctcatttccatgttccttaatgagcgtctgtatcaactaccctatcgtctgtattttctttcagttcatgttctagtttttctgttcctctggattttctttcagttcatgttctagtatgatgtattgtcaacctaataagtactactttgtcatcgtgagtaccttcttggatacatatcaggagcttgtatcatcgatttagtacttcanaaaaaaaa

SEQ ID NO: 1884 - DNA, 739 bp, Triticum aestivum
gaagctcactcaaacgaagccacacaacaccatctcctcagtagcattaccagagcctcccagttagcaatatggcaaagtgtctcgccgtcgcgctcctgctgctggtggtgctcgcgtactgcgacgggagggagctgaaccagaaggaccaggcactggcaacggcacgcggtgccggtgccgccggtggtggcgtcggcgaagagaaggttttggggttgccagagttgccgcttgtgggagccgttacagggaccagtaccgttaccggtccggtggtggtggttcctgcccttcccgggatcccggcacacccatgatcatctccacttcatgtgctggcttacagctgaagctgaacttgtagttttatgacttctaggtagcaccgtccgtaagataaacgtcggcctgaccggcgtttcgctcatttccatgttccttaatgagcgtctgtatcaactatcctatcatctgtattttctcccgctaggatcggaaatcttatattttctatatccatataccgttgaatccttggggttccagaatccgcctattttactagtcttcggaaacgaaaaaccctgaaacaagaagagttggatatgttatgtagggtattttctttcagttcatgttctagtattttccgtttctctgtattttctttcagttcatgttctagtatgatgtatcgtcaacctaataaatactactttgtcaaaaaaaaaaa

SEQ ID NO: 1885 - DNA, 994 bp, Triticum aestivum
cacagccacgcaacactatcactcaaacacagccgcacaagctagacttacctcctcagtagtataccggagcctcccagctagcaatatggcaaagtgcatcgccgtcgcgctcctgctactggtggcgctcgcgtactgcgacgggagggagctgaaccagaaggaccaggcactggcaacggcacgcggtgccggtgccgccggtggcggcgttggcgaggagaagattttggggttgcctgacctgccgcctgtgggaaccgttaccggtaccagcaccactaacggcccgctggtggcgcttcctgccattcccgggatccctgctcacccatgatcacctctagttcatgttctggcttacaagatgaagctcacctcgtgactttagacttcaaggctgtagcttaacatcgcccggaaggcaaacaccggcgtttcgctgatgtccatgttccttttaatgggcgtctgtatcaactatcctcgtctgtaattcttttcggtccgctttcctgtatttttcgatccttgatgtgctacatgtataaatgctactttcttcgcaaaaaaaaaaacaaagggcggccgctctagactatcactccaggggcccaaggttacgcgttcccggttttctggtggaaaggtgctccccatagggagtcgtattataagccaggccgtggccgccgttttcaaaggtcagggaatgggaaaaccggtgagcctgggatcttgggggaaaggacccgtacgcctcgcgggggtgacataatgggcccaactaacctcacagagaggctacgcctcgaaggtcaattgaaaaacgttaaggggcttctccgtggttaaacacccccaacaattgctggggggctggacaatttgggttcccgggcgttgggattttctaacaacattttgcgcccgcgcgcccaccgcgattctgcactccgggagcgctttttcaagatttcccaatgccccg

SEQ ID NO: 1886 - DNA, 573 bp, Triticum aestivum
cacgcgtccgaaacgcagccacacaacaccatctcctcagtacatcagagcctcccagttagcaatatggcaaagtatctcgccgtcgcgctcctgctactggtggtgctcgcgtactgcgacgggagggagctgaaccagaaggaccaggcacttgcaacggcacgcggtgccggtgctgccggtggtggcgtccgcgaggagaaggttttggggttgccggagctgccgcttgtgggaactgttacagggaccagtaccgttaccggccctgtggtggtggttcctgcccttcccgggatcccggcacacccatgatcatctccacttcatgtgctggcttacaagctgaagctgaacttgtaggtttatgacttctaggtagcaccgtccgtaagataaacgccggctcatttccatgttccttaatgagcgtctgtatcaactatcctatcgtctgtattttctttcagttcatgttctagtattttccgttcctctgtattttctttcagttcatgttctagtatgatgtatcgtcaacctaataaatactactttgtcatcgtgagt

SEQ ID NO: 1887 - DNA, 771 bp, Triticum aestivum
cacagccacccaacactatcacaaagccgcacaagctagacaatctcctcataagtgctagcggagcctcccagctagcaatatggcaaagtgcctcgccgtcgccctcctgctgctgctggtgctcgcgtactgcgacgggagggagctaaaccagaaggaccaggcactcgcaacggcacgcggtgccggggccgccggtggtggcgtcggcgaggagaagattttggggttgcctgacctgccgcctgtgggaaccgttaccggtaccagcaccactaacggcccgctggtggcgcttcctgcccttcccgggatccctgctcacccatgatcacctctagttcatgtgctggcttacaagatgaagctcacctcgtgactttacacttctaggctctagcttaacatcgcccggaaggccaacaccggcgtttcgctcatgtccatgttccttccttaatgggcgtctgtatcatctatccccgtctgtatttcttttcagttcatgttctagtatttttcgtttccttgatgtgctacatgtatgatgtatcatcaatgtaataaatacttcttttttcaatgtgttcgccttttgcatcatctacgtacaacttcgtcactcttaactaatcacaaactcccaagtccagagcatgttcactaagttgatgacagcccgcacgctgtgcgaaaaatgttttgtaatacacttaaatgcgatttgattgtaagggacatggatatttcaagtagcaatatgagaat

SEQ ID NO: 1888 - DNA, 583 bp, Triticum aestivum
ccacgcgtccggcagccacacaacaccatctcctcagtacatcagagcctcccagttagcaatatggcaaagtatctcgccgtcgcgctcctgctactggtggtgctcgcgtactgcgacgggagggagctgaaccagaaggaccaggcactcgcaacggcacgcggtgctggtgcgggtgctggtggtggcgtcggcgaggagaagattttggggttggcagagttgccgcttgtgggaactgttaccggtaccagcacagttaccggtccggtggtggtggttcctgcccttcccgggatccctgctcacccatgatcatcaccagttcatatgctgtcttacaagatgaagctgaactagtgggtttatgacttctagctagcaccgtccggaagataaacaccggtgtttcgctcattttcacgttccttcatgagcgtctgtatcaactatcctatcgtctgtattttctttcagttcatgttctagtattttccgttcctctgtattttctttcagttcatgttctagtatgatgtatcgtcaacctaataaatactactttgtcatcaaaaaaaaa

SEQ ID NO: 1889 - DNA, 610 bp, Triticum aestivum
ctctctctctctctctctctctctctctctctctctctacacagccacccaacactatcacaaagccgcacaagctagactatctcctcagtagaactaccggagcctcccagttagcaatatggcaaagtgcctcgccgtcgcgctcctcctactggtggcgctcgcgtactgcgacgggagggagctgaaccagaaggatcaggcactagcaacggcacgcggtgccggtgctggtggtgctgtcgacgagtccaaagcactagggctgccagacctgccgcttgtcggaaccgttaccggtaccagcaccattaccggcccgctggtggtgcttcctgggatccctgctcacccatgatcatctcgtgttcatgtgcttacaagatgaagctcaccttgtggctttagactttaggctgtagctagcaccgtccggaggaaaaatgccggtgtttccctcatgtccatgctccttaatgggcgtctgtatcaaccagcctgtcatctgtatttctttgcagttctttgttccagtagttttcgttccttgatgtgccacatgtatcatcaaagtaataaatactactcctttgtcaaaaaaaaaaaa

SEQ ID NO: 1890 - DNA, 2343 bp, Hordeum vulgare
attcggcacgaggaaaacctcgcccacttcctctcccattcctcgaccccccctcccgaagaaggcggcggcagcaggagctgggtgccagtgcggggagtgaccggcgcgtggagatgaagtatgtgctggtgaccggcggcgtggtgagcgggctgggcaagggcgtgacggccagcagcatcggcgtgctcctcaaggcctgcggcctccgcgtcacctccatcaagatcgatccgtacctcaacaccgatgccggaaccatgtcccccttcgagcacggcgaggtcttcgtcctcgaagacggcggcgaggtggacttggatcttggaaattacgagcggtttttggacatcaagttgacccgcgacaacaacataaccactgggaagatctaccaggctgttattaacaaggaacgaaaaggagactacctgggaaaaactgttcaggttgtgccgcacattactgatgaaatacaagactggattgaacgtgtggcgatgaatccggttgatggcacagataagccagctgatgtttgtgtcatagaacttggtggcaccataggggacatcgaatcaatgccttttatcgaagcattgggtcaattttcgtaccgcgtaggacctggaaacttttgcttggttcatgttagtcttgtaccagttctaaccgtagttggtgaacagaaaacaaagcctacccagcatagtgtccgtggactaagaggacttgggttgatgcctgatatcttggcatgccgcagtactcagccactggaagaaaatgtgaaactgaaactctcacagttttgccaagttccggtttcaaatatcgttaatctccatgatgtaacaaatatctggcacatccctttgttgctcagggatcagagagcccatgaagctattttgaaggttctgggcctttggtgtgtggggaaagtgcctaaagaacctaagttgtctgaatggactgaaagagccagcagattcgacaaactgaaatctccggtcaggattgccatggttggaaaatataccggcatatcggattcctacttatctattttgaaggctcttctgcatgcgtcggttgctttggacaggaaactggtggtggactgggttccttcctgtgatcttgaagattctgctgccgaagagacgcctgaagcctataaaaaagcatggggtctgctaaagggtgcaaatggggtgctagttccgggaggctttggagacagaggtgtccaggggaaaatccttgctgcgaaacatgcacgagaaaacaacgttccgtaccttggcatttgcttgggcatgcaaattgcagtgatcgagtatgcacgttctgtcatgaagctgcgtgatgctaatagcacggagttcgatcctgctgcaaaaacaccatgtgttatcttcatgccagagggctccaaaacccacatgggtgcgacgatgcgcctcggttcaaggaggacatttttccaggtcaacaactgcaaatctgctaaactgtatgccaatgctaactatgttgacgaaagacaccgccacagatacgaggtgaaccctgacatggtctcagactttgagaaagcagggctttctttcgtgggcagggatgaaagcgggagacgcatggagattattgagctgccagctcataagttcttcgtgggtacgcaatttcatcctgaatttaactctaggcctggaaagccatcaccacttttcttaggactgatcgcggcgtcgtctggacagctagagcccttgcttcagcctacttcgggtgctgtcacctcgccgaccaggtgcatcgccggtccaggagcccctaaggcgaagtttaagatgaacggcctgaagtcgacgtactacgcgaatggcagcagcattcacatctagcagcacggcagcagatcagtttttctttttcttttctgcatgtgtttttttccttttctttttctttttctttagtatggatctatctctctgatcaaggaagaagagatgtcagctccagcgacatgacgagccgtttccggtttttatgaagggaactatttggcgtcgctcgcgcggaagcaaaattagctagggtttattagtgctgctctagtcttgcttgcttgttcgtttgtttcattaaggattttattatcaaggttgtaaaggctggggatgtgcagctagcttcagtttcaagcctgccgtctcgcctgcttgtacattctaaaacagaaccgctgctctctcgagtgactgaatgattataagctgctgtagtagtatttggggaaacaaatatgtaccaaactgttccgatctg

SEQ ID NO: 1891 - DNA, 2544 bp, Brachypodium distachyon
ttccagagcccagcctaaacctcctctcctttctcactccagctctcagcctcctgccaccactagcccgagaaacagagcaaggattcgctcttgctcctttcctagccgagctaaaataaacgtgtacgcgcgggacgacctgccatgaagtacgttgtggtgaccggaggggtggtgagtgggctcggcaagggcgtgacggccagcagcatcggcgccgtgctcaagtcctgcggcctccgggtcaccaccatcaagatcgatccatacctcaacactgatgccggcaccatgtctccgattgagcatggcgaggtctttgttttggacgatggcggagaggtggacttggaccttggaaactatgagcgttttctggatatcaaattgaccggtgacaacaatataacgacaggaaagatctatcaggctgtcattgacaaagaaaggagaggagactacttggggaaaaccgtccaggttgtgccacatattacagatgaaatacaagactggattgaacgtgtggcgatgaatccggtcgacgggaaagaagggcctccggacgtttgtgtcatagaactcggcggcactataggggatattgaatcaatgccttttattgaagctttaggccaattttcataccgcgtaggaactggaaatttctgcctggtccatgtcagtcttgttccagttctaactgtagttggtgaacagaaaactaagcccacccagcatagtgttcgtggcctaaggggacttggattggcacctgatattttagcatgtcgcagcactgagccactggaagaacatgtgacagccaagctctcacaattctgcaacgttccaatttcaagtatcgtgaatctccatgacgttacaaacatttggcacatccctttgttgctaagggaccagaaggcacatgaagctattcttaaagttttagatcttcagcttcttggcaaggtacctcgagaacctaagttggctgaatggactgaaagagccagcaagttagacaaactgaagactccggttacgattgccgttgttggtaaatatactggcctctcggattcctacctgtctattcaaaaggctcttttgcacgcatcagttgtgatggaaagaaaacttgtagtagagtggattccatcctgtgatcttgaagattctgcagctaaagatacccatgaagcctatcaaaaagcatggaaactactgaagggcgcggacggtgtacttgttcctggaggttttggagacagaggagttcagggcaaaattctcgctgcaaaatatgcacgggagaacaatgttccgtatcttggcatttgcttgggtatgcaaattgcagtgattgagtttgcccgttccgtcatgaaattatgcagcgcaaatagcacagagtttgatccagctacaacatcaccttgtgtcattttcatgccagagggctccagaacccaaatgggggcgacgatgcgactgggatcaaggagaacatatttcctaggcaacaactgcaaatctggaaagctgtacggcaatgctagcttcgtcgacgaaagacatcgacacagatacgaggtgaaccctgaaatagtcccagagctagagaaggccgggctttcatttgttggcaaggatgaaagtggaagtcgaatggagatcgttgaactgcccagtcatgatttcttcatcggtgtacaattccatcctgagttcaagtcaagaccaggaaagccatctccacttttcttagggttgatagcagcggcatctgggcagctagaccttttgctccagcgcagcagcggtgttgtctcttcgaacttggcaccgagatgtatcaccaaaggcaccactgtcccggtcatcaaagtgtacccaaacgggcacatcaagaagccgttgaaaagcctggtgaatgggtactacacaaatagcaacggcatccacatctagctgagcagcggcagcctgacatttttcttctacacctttgcttgtgccatttttgtcctttcggttttggacttctgctcaactaagaaggctaagggagtgtttctgtgtttggtatggcatggctccgctccaggatttttaaagctccggatcaagcttctctcgcacctgaggaaattcgattcaggatctggagctgtgagaggaagtgtttggttacgaggttagctcctgaagctccacgacacgcagttccgacatttttaaagaggaacatcctccggtcatgctgaagcaaaggtagccatggtagggtatagtgtgctgtgtccgttttgtgttggacaagactgttttgtatcttgtatctgattcaaggatatgacggtgatgctgaatgctaattaagtctcactgctgtgcctgctgctctaccaggtcgggaaattggaacgggttcatgttttcttaatgaaaatatcccagtccagattcaggtttcatcctatacagtgtaaaaaagattgattgttcttcactaatattggactgcgctccagc

SEQ ID NO: 1892 - DNA, 2509 bp, Brachypodium distachyon
aaccaaacctccccccatttcctcctccttctccccaagacgaaactagccatagccactgaagcagcagcagtgagctgcgactactagctgacaaggccagcagtgagcagaagcggaagaacagcaagcaatcaagcgcgagatcgagcggccatgaagtacgtgctggtgaccggcggcgtggtgagcgggctcggcaagggcgtcacggccagcagcatcggcgtgctcctcaaggcctgcggactccgggtcacctccatcaagatcgatccatacctcaacaccgatgccggaaccatgtccccgttcgagcacggcgaagtgtttgtgctggacgacggtggtgaggtggacctggaccttggaaattatgaacggtttctggacatcaagttgactcgcgacaacaacataaccacggggaagatctaccaggctgttattgacagagaacgaagaggtgactatcttggaaaaactgttcaggttgtaccgcacattacagatgcaatacaagagtggattgaacgtgtggcattgaatccagttgacggcacagaagagccagctgatgtttgcgtcatagagcttggtggcactataggggatatcgaatcaatgccatttattgaagcattaggtcaattttcgtaccgcgtaggacatggaaacttttgcttggttcatgttagtcttgtaccagttctaaatgtagttggtgaacagaaaaccaagcccacccagcacagtgtccgtggattaagaggactgggattgatgcctgatatcttggcatgccgcagtacccagccgctggaagaaaacgtgaaactgaaactctcacaattctgccaagttccgatttcaaatattgttaatctccatgatgtcacaaacatttggcacatccccttgttgctcagagaccagaaagcccatgaagctattctgaatgttttaggcctctggtgtgtgggaagagtgcctcaagaacctaagttggctgaatggactgaaagagctagcaaatttgataaattgaaaactccggttaggattgccatggttggaaaatatactggtatatcagattcctacctgtctgtgttaaaggctcttctgcatgcatcggttgctttggacaggaaactcgtggtggattgggttccttcatgtgatcttgaagattctactgctaaggagacgcctgatgcctacgaaaaagcatgggttctactaaagggtgcgcatggtatactagttccgggaggctttggagatagaggtgtccagggaaaaattcttgctgcaaaatatgcacgagaaaacaaagttccgtatctcggcatttgcttgggcatgcaaattgcagtgatcgagtatgcccgttctgtcatgaagcttcatggcgctaatagtacagagtttgatccagctgcaaaaacaccatgtgttattttcatgccagagggctccacaacccatatgggagcaacaatgcgccttggttccaggcggacatttttccaagtcaataactgcaaatctgctaaactgtattccaatgctagctatgtagatgaaagacaccgccaccgatacgaggtgaatcctgacatggtgccagaatttgagaaggcaggcctttctttcgtgggtagggatgaaagcgggaggcgcatggagattattgaactaccaaatcataggtttttcgttggcacgcaatttcatcctgagttcaactctagacctggaaagccatcaccacttttcttaggattgatagcagcagcatctggacagctagaccacctgctgcaacgtactggtggcgcagtcaggtgcatcacaggcactgggactggcaagccgaagctgttcaagaagaagccgtttaacggcctggtgaccacgtactatgcaaacggcagcagcatccacatttagcagcacagtgaatggtttctggtgccccctttttctttctttttttggcattttgttttcctttactctggcatggattcatcatcaatccatctatctgctcaaccaagaagaagagatcgaaattagtgatggatcatcgttagctgctgcagctgacatgacgaagccgtttccgggtttttttaagaagggaactatcggcgcgcatccaagcaaaattagctattagtagggtttattggtagtgctctagtaatgctatccttttttttttgtttcatgaaggacttcaatcaaggttttaaggctggggatgtgcagctttagctttagtttttaagcatgccgtctcgcctggttgtacattgtaaaagtactaaacggctggcttctccatgtactggatatgattacaggagtagtatttcaggggggaaatttacctacccagattattcagatctgaaactttgctgcagtcttctcccgtttttgtatatatctggaatgcattcctatgacagaaattatcatttttcctgggtgtcgc

SEQ ID NO: 1893 - DNA, 2308 bp, Festuca arundinacea
  misc_feature (514)..(514): n is a, c, g, or t
  misc_feature (534)..(534): n is a, c, g, or t
  misc_feature (538)..(538): n is a, c, g, or t
  misc_feature (541)..(541): n is a, c, g, or t
  misc_feature (611)..(611): n is a, c, g, or t
  misc_feature (1312)..(1312): n is a, c, g, or t
  misc_feature (1405)..(1405): n is a, c, g, or t
ggcacgaggcaaaaccagttcctctccctccttcccaccttctctccctcccaaggcagttacagcctatagcagcaatctccagtgcagtgaccggggacgagcatgaagtacgtgctggtgaccggcggcgtggtgagcggcctcggcaagggcgtcacggccagcagcatcggcgtgctcctcaaggcctgcggcctccgcatcacctccatcaagatcgatccatacctcaacaccgatgccggaaccatgtcccccttcgagcacggcgaagtgtttgtcctggacgacggtggtgaggtggacttggaccttggaaactatgagcggtttctggacatcaagttgactcgcgacaacaacattaccacggggaagatctaccaggctgttattgacaaagaacgaagaggggattaccttggaaaaactgttcaggttgtgccacacattacaaatgagatacaagagtggatcgaacgtgtggcgatgaatcccgttgatggcacanacaagccagctgatgtgtgngtcntanaacttggtggcactataggggacatcgaatcgatgccttttatcgaagcattaggtcaattttcgtaccncgtaggagctggcaacttttgcttggttcatgttagtcttgtaccagttctaaatgtagttggtgaacagaaaaccaagcctacccagcatagtgtccgtggactaagaggacttggattaatgcctgatatattggcatgccgcagtaccgagccactgggaaaaaaatgtgaaactgaaactctcgcagttttgccaagttccggtttcaaatattgttaatctccatgatgtaacaaacatttggcacatccccttgttgctcagggaccagagagcccatgaagctattctgagggttcttggcctttggtgcgtgggcaaagtgtctcaagaacccaagttgtccgagtggactgaaagagccagcaagttcgacaaattgaaatctccggttaggattgccatggttggaaaatatactggtatatcagattcctacctgtctattttgaaggctcttctgcatgcatcggttgctttggacagaaaactcgtggtggactgggttccttcctgcgatcttgaagattctgcagctaaagagacgcctgatgcctatgaaaaagcatgggatctgctaaagggtgcaaatggtgtactagttccgggaggctttggagatagaggtgtccagggaaaaattcttgctgcaaaatatgcacgagaaaagaatgttccatatcttggcatttgcctnggaatgcagattgcagtgatcgagtatgcccgttctgtcatgaatatgtgtggcgctaacagcacagagtttgatccagctacaaacacaccntgcgttattttcatgccagagggctccacaactcacatgggtgcaacaatgcgccttggttcaaggaggacatttttccaggtcaataactgcaaatctgctaaactgtatgccaatgctaactatgtggacgaaagacaccgccacagatacgaggtgaatcctgacatggtctcagaatttgagaaggcaggcctttctttcgttggaagggacgaaagtgggaggcgtatggagattattgagctaccggctcataggtttttcgtgggcacgcaatttcatcctgaatttaactctagacctggaaagccgtcaccacttttcttaggattaatagctgcatcatctggacagctagagcacctgctgcagcgttccagcggcactgtcagctcgccgtccagatgcatcaccggcaccggaaccgccaagttcaataaactgttcaaggagaaaccgttgaacggcctggtgaccacgtacttcgggaacggcagcagcattcacatctagcatcacagcagctgaccttttctttttttctgcatgggtcgcgttttctttcttttttctctttacttagtatggatttgaatctctctgatcaaccaaccaagaagagatcgtcagctccagcgacatgacgagccgtttccggggttttaggaagggaactattgggcgcatgagcgcgtgtaagcaaattagctagggtttattagtgccactctagtctgctattcctttcgcttgcttgcttgtttgttttattaaggattaatattaaggttgtaaggccgtggacgtgcagctagcttcagtttcaagcctgccgttcgcctgcttgtacattgtaaacaagaactgctgctatccagagactgaattgttcctcgtgcc

SEQ ID NO: 1894 - DNA, 2505 bp, Zea mays
aaaccccaacctcccttggtttggctggcggctagcccctaaccaaaaaaaataaaataaaaccaactctcccattcggccatttgcccatttcccatctcgccttcgcttcccacgcccctccgtcccgcctcgccgcggcaaggcaccgccgccaaccgccctcgtccctcttcgactcgaccgcgtgagtgagacgaccgcgcgcgcccctcgcccgcccgccaggaggagatcgacccccgaacgcgtcatgaagtacgtgctggtgaccggcggcgtggtgagcgggctcgggaagggcgtgacggccagcagcgtcggcgtcgtcctcaagtcctgcggcctccgcgtcacctctatcaagatcgatccatacctcaacatcgatgccggaaccatgtctccgctcgagcatggcgaagtgtttgttttggacgacggtggtgaggtggacttggaccttggaaactacgaacgatttctggacatcaagctgactcgtgacaacaacataaccacggggaagatctaccagtctgttattgacaaggaacgtagaggggattacctaggaaaaactgttcaggtcgtgccgcacatcacagatgaaatacaagagtggattgaacgtgtggcaatgaatccagttgatggcacagaagagccagctgatgtttgtgtcatagaacttggtggcactataggggacattgaatcaatgcctttcattgaagcattaggtcaattttcataccgtgtagggcctggaaacttctgcttggtgcatgtcagtcttgtaccagttttaaatgtggttggtgagcagaaaacaaagcccacccaacatagtgttcgcggacttagaggacttggactcatgcctgatattttggcatgccgtagtacacagccacttgaagaacatgtgaaagtgaagctcgcacaattttgtcatgttccgatatcaaatatcattaatctccgtgatgtaacgaacatttggcacatccctttgttgctcagagaccagaaggcccatgaagctattttgaaagtgttagacattcagtgtgtgggtaaagttgctcgagaaccccagttgtctgaatggactgaaagagccagcagatgtgacagattgaaatctccggttaggattgctatggttggaaagtatactggcctgtcagattcctacctatctgttatcaaggctcttttgcatgcgtcggttgctttggacaggaaacttgtggtagactgggttccttcctgtgatcttgaagattctgcagcagaagagaatcttgatgcctacgaaaaagcatgggaattgttaaagggtgcagatggtgtgttggtgccagggggttttggagacagaggagttcaagggaaaattctggctgcaaaatatgcgcgagaaaacaacattccatatcttggcatttgcttgggcatgcaaattgcagtgattgagtttgcacgttctatcatgaagttgcacggtgcaaacagcacagagttcgatccaaccacaaaaaccccatgtgttattttcatgccagaggggtcaaaaacccatatgggggcaacaatgcgccttggatcaaggaggacctttttccaggtcactaactgcaaatctgctaaactgtatgggaatgctagctacgttgatgaacggcaccgccacagatacgaggtgaatcctgatatggtcccagaatttgagaaggcagggctttctttcgttggcagggatgaaagtggtaaacgcatggagattatcgaactgccaactcataggtttttcgtcggtgcacaatttcatcctgaattcaagtcaaggcccggcaagccatctccgcttttcttaggattggtagcagcgtcatcaggtcagcttgatcacctgctccaacctggtcttatcagttcgactggcagacacacctgcagcaaaggaggagcgcaaaaattaaaggctgggcacgtcatgaagccactgaatggcctggtgaacgcacactattcagcaaccggcaatggcgccattcccatctagcagcgcagagctgcgacgcgtcgcgtgcttgtttgggatttctcttctaccgttactgcttgttctttttttttccctttccttcgagggtgttcttccgtacgttctgccaggccaactgagaagaagagaagggctgtttgctctagcgacacgggcagccgcgtttccgatgttttaacgtggaagcatttggcatggaagctgtcgcatgcatcaagaggcaaatctagcaggttagctagagtttgattagtagtggtaatccgatatatatgctggttgatttgttcgtttgtttgctaagattacaagggccggtgatgtgcagctagctggtagtgtagcctgccgtctcgcctcatttgtacattgtaaaacaactgctactctccattgactgactgaatggacgagtataaacgtattggacc

SEQ ID NO: 1895 - DNA, 2506 bp, Zea mays
agcctcaaactcttgccctccccccggcaccacactagcctagtgagaagtgcagcagcagcaccagcggcagaagtgttacttagttgctcctcctacctgtgctgctgcgcaggagcagagcctgaaaggacgacggccgtcggcgtaaggggagcgagcgagcgagcggccatgaagtacgtgctggtgaccggaggggtggtgagcgggctcggcaagggcgtgacggccagcagcatcggcgtcgtgctcaaggcctgcggcctccgcgtcaccaccatcaagatcgatccatacctcaacaccgatgctggaaccatgtcgccgttcgagcacggggaggttttcgttttggacgatggcggagaggtggacttggaccttggaaactacgaacgttttctggacatcaaattgacccgcgacaacaatataaccacgggaaagatcttccaggctgtcattaacaaggagaggagaggcgactacctagggaagaccgtccaggtagtgccgcacatcacggatgagatacaggactggatcgaacgcgtcgcggtggtcccagtggacggcaaggaagggcctcctgacgtctgcgtcatcgagctcgggggcactataggggatatcgagtcaatgcctttcattgaagcgttaggtcaattctcgtaccgtgttggacctggaaacttctgtctcgttcatgtcagtcttgttccggttctaaatgtagtcggtgaacagaaaactaagcctacacagcacagtgttcgagggcttagagggcttgggttagcgccggatgttttagcatgtcgcagtactgagccattggaggaacatgtgaaggccaagctttcacagttttgccatgtcccggtctcaaatatagtgaacctccatgacgtgacaaacatctggcacatccccttgctgctaagggaccagaaggcccatgaagcgattctgaaggttttagacctccagtatgatggaaaggtgcctcgggaacctgagctaaccaagtggactaaaagagccaccaagtttgacaagttgaagactccggtcaagattgccatggttggaaaatacactggcctgtcggattcctacctgtctgtcataaaggctcttttgcatgcatcggttgctatggaaagaaaacttgtagtcgagtgggttccttcctgcgacctggaagattcttcagctaaagagaaccctgaagcccataaaaaagcatggaaattgctgaagggcgcagatggcgtactcgtccctggagggtttggggacaggggagtccagggcaaaatcctcgccgcgaaatacgcacgcgagaacaacgttccttatcttggcatctgcctgggaatgcaaatcgcggtgatcgagtttgcccgctcggtgatgaagctacgaggcgccaatagcacggagttcgatccagctacgacgtcaccctgtgtcatcttcatgccagagggctcaaaaacccaaatgggagccacgatgaggcttgggtcgaggaggacctatttccatgtcagtggctgcaaatctgcgaagctgtacggcaacgccagctctgtagatgaaagacatcgccacagatacgaggtgaaccctgacatggtcccagactttgagaaggccgggcttcagttcgtgggcaaagatgagagtgggaaacgcatggggatcgttgagcttccctctcacaagttcttcatcggtgcacagttccatcctgaattcaagtcgagaccagggaagccatctccgcttttcttagggctgatagccgcggcgtctgggcagctagaaccattgcttcagcgcagcaatccgacaacgaaagcatgttcgatcagtaaagtcccgaaactgaaactgtaccccactgggcctgtgaataatccactgaacagcttggtgaacgggtactacccaaatggcactgggatccacacctagaagcgtagcgcttagcgatggtttggttggtatttgctgctatggtttttttgcttgtacccctcctttttcatgtgttcctttttttcagtttgttatttgtctctgatcaactgagagaagagaaggctaagattcagcaagcccccagctccagcgacacatggttccgacatttttaacgaggaacgccttccagtccgttgaagcgagctagccatagggtggtgaggtctagtgtgatgttgttgttgtttttttctctttcctttttttttggcctggaactaaggcgcgaagtgttttgagtagcgctagtagagcctggaagaagttatctaaactatttgtacattatggaagaacttatctaaggactgaatacacaaatgcttggccatgattgctttgttgccacaatatgaacaaccacgctcagatgaagagtattggtgttgttaaaaaatgccagtgatattgttgttgttaatgtttgtgcctgtgttgccctactgcatcg

SEQ ID NO: 1896 - DNA, 2326 bp, Zea mays
agcctaaaaacttgcccagagcgcctgaacctgcctccgctccactcttgcccccccctggcaccacactagcctagtgagtagtgcagcagtcttgctcggttgctcctacctgtcctgcacagcacaggagcagagcccaggaccgtcggcaaaaggggagcggccatgaagtacgtgctggtgaccggaggggtggtgagcggcctcggcaagggcgtgacggccagcagcatcggcgtcgtgctcaaggcctgcggcctccgcgtcaccaccatcaagatcgatccatacctcaacactgatgctggaaccatgtctccattcgagcatggagaggtgtttgttttggacgatggtggagaggtggatttggaccttggaaattatgagcgttttctggatatcaaattgacccgtgacaataatataaccacaggaaagatctatcaggctgtcattaacaaagaaaggagaggtgactacctaggaaaaaccgtccaggtagtgccacatattacagacgaaatacaagattggattgaacgcgtcgcagtgattccagtcgacggcaaagaaggacctcctgatgtttgtgtcattgaacttgggggcactataggggatatcgagtcaatgcctttcattgaagcattaggtcaattttcataccgtgttggacctggaaacttctgtctcgttcatgtcagtcttgttccggttataaatgtagtcggtgaacagaaaactaagcctacacaacatagtgttcgagggcttagaggacttgggctagcaccggatgttttagcatgtcgcagtactgagccactggaggaacatgtgaagatcaagctttcacaattttgtcatgttccgatctcaaatatagtgaacctccatgacgtgacaaacatttggcacatccccttgctgctaagggaccagaagacccatgaagctattctgaaagttttagatcttcagtatgatggaaaagtacctcgggaacctgagttagggatgtggactaaaagagccaccaagttggacaaattgaagacttcggtcaagattgccatggttggtaaatacactggcctgtcggactcctacctgtctgtcataaaggctcttttgcatgcatcagttgctatggaaagaaaacttgtagtcgagtgggttccttcctgcgatctggaagattcttcagctaaagagacccctgaagcccataaaaaagcatggaaattgctgaagggtgcagatggtgtactcgttcctggaggattcggagataggggagtccagggcaaaattcttgccgcaaaatatgcacgcgagaacaatgttccttatcttggcatttgcttgggaatgcaaattgcagtgattgagtttgcccgttcggtgatgaaactacgaggtgccaatagcacggaattcgatccagctacaacatcaccctgtgtcatcttcatgccagagggctcaaaaacccagatgggagctacaatgaggcttggatcgaggagaacctatttccatgtcagtggctgcaaatctgcaaagctgtatgccaatgccagctctgtagatgaaagacatcgccacagatacgaggtgaaccctgatatggtcccagacttcgagagggccgggcttcaattcgtgggcaaagatgaaagtggaaaacgcatggggatcattgagcttccctctcacaagttcttcatcggtgcacaattccatcctgaattcaagtcgagaccaggaaaaccatctccgcttttcttagggctgatagccgcggcatctggacagctagagcctttgcttcaacgcagcaatccgacaacaaaagcatgtcctatgagtaaagtcccgaaactgaaactgtacccaactggacctgtgaataatccactgaacagcttggtaaatgggtactacccaaatggcactggcatccacacctagaagcataatgcttagcgatggtctatttgatgtttgttcctatggttttgcttgtacccctttttatgtttgtttttcagtttgtatttgtctctgatcaactgggaaggctaagattcagcaagccccagctccagcaacacatggttccgacattttaacgaggaacgtcctccggtccgttggagcaaactagctatagagtggtgaggtctagtgtgatttttttgagccctggaattaagcgcgggaagtgttttggtagcgttagtagagcctggaatctcaactatttgtacattatggaagaacttatctaaggactgaatacacaaatgcttggcca

SEQ ID NO: 1897 - DNA, 2504 bp, Oryza sativa
ctcctcccttcctctctccccttgtcgagaggcggctgcgcggcgcgccctcctcctcctccccccaaaaccctcctcctccctcctcctcgggctgcgcggcggcgctcgactccggagggattcagggggaagaaggttcgccgcgcgtggctctctctctctctctctctcccgggggcgcgagatgaagtacgtgctggtgaccggcggggtggtgagcgggctcgggaagggcgtcacggcgagcagcatcggcgtcgtcctcaagtcgtgcgggctccgcattacctccatcaagatcgatccttaccttaacacagatgctgggaccatgtccccgttcgaacatggtgaggtttttgtgcttgatgatggtggcgaggtggacttggatcttgggaattacgagaggtttcttgacattaaactaaccagggacaataatataaccacaggaaagatctaccagtccgttcttgaaaaggaaaggaagggggaatacttgggaaagactgttcaggttgtcccgcatatcacaaatgccatacaagagtggattgagcgtgtcgcaatggtacctgtagatggcaaggagggaccagctgatgtttgtgtgatagaacttgggggtactataggggatattgaatctatgccatttatcgaagctttgggccaattctcatatcgtgttggtcctggtaacttttgtttggtgcatgttagtcttgttccagttctgaatgttgttggtgaacagaaaactaagccgactcaacatagtgtccgtggattaaggggtcttgggctcacaccaaatattttagcctgtcgcagtactaaggaactggaagaaaatgtgaaggagaaactctctcagttctgccatgtaccggcagctaacattgtcactctgtatgatgtttccaacatttggcgtattcctttgttgctacgggaccaaaaggcacatgaagccattcttaaagtgctgaaccttgatagctttgctcgggggccaaagttggatgaatgggtcgcaagagctacgttatttgatgcacttcaggatactgtgaggattgctatggttgggaagtatactggtctatctgattcatacctctctgtgttgaaggcactcttgcatgcttctgttgattgccgcaggaagcttcttgttgattgggttgcttctactgatctcgaagactccactgccattgaggcgcctgatgcttataaagcagcatgggatttactgaagggtgccaatggtgttttagtacctggtggctttggagatagaggtattcaagggaagattttggctgccaagtatgcccgtgaaaacaatgtaccatatcttggcatatgccttggaatgcaacttgctgtggttgaatttgctcgaagtgtcatgaatctccctgaagcaaacagcacagaatttgatcccaatgccaagaccccatgtgttatttttatgcctgagggttctaaaacacatatgggtggcacgatgcgcctaggatcaaggaggacatttttcgaggttgctgattgcaagtctgctaaattgtatggcaatgtcagttatgtagatgagaggcatcggcacagatatgaggtgaatccagatatggtgccagagtttgaaaatgctggacttcagtttgttgggaaagatgagactggaaggagaatggagataattgaaatccccaatcaccgatattttgttggtgcacaattccatcctgaattcaagtcaagaccttcaaaaccgtctccactctttgtcggactaattgctgcctcatctgggcaactggatagattgctgcaaggcagctgcaatggccacgtggtttctactaaacattctctgagcaatggtgcttacacatctacagtacaccaaaatgggcacgcaaagaagcttgccaatggtctttccaatggaacatattatcccaatggaaatggcgtgcatgcctagttcttcagtaggtggcctaaggatttacacattccctttttgctgtttctattgaattgcatcagttttgtcgtggctggcctcgttaatctttggtcgctcgaggaagaaaaaatgttcttgtgctcgatgcggactgtgcgaaggatggtgctcgttcggtgggtttttgaaggaaccgggctgaatctcattgaaggtgtgagattgtggtttgcgtgttcgtccctacccttttctgtaagccaaggggggcagaagtgggtaagaagagttctcatgctgtatatctggaaagaaaagaaatgctggatgtttttgttctttttgcttgataaatgctgcgctggaacagaggatattgatgttaggcagtttgtactttggcagttttgtgcttttgcaaacaagttaaacgttttttgcattactgtaccagattgtctgccaattttgcgtgattattctcataatactggatattctgaaacttgctcaa

SEQ ID NO: 1898 - DNA, 2450 bp, Oryza sativa
cacatccccattgcagaacctctctcccttcttggttcttcttctcatctcctcccactccagctctgcccctgagccaagaactgagcagcagagagctcgtggtctctttgccagcttctcctcagtcctcaccaagctgttcttgcagagaaaacatagccaaagagctaatttgagctcccaccatgaagtacgtgctggtgacaggaggggtggtgagcggcctcggcaagggcgtgaccgcgagcagcatcggcgtcgtgctcaaggcctgcgggctccgcgtcaccaccatcaagattgacccatacctcaacactgatgctggaaccatgtctccgttcgagcatggtgaggtcttcgttttggacgatggtggagaggtggacttggaccttggaaattacgaacgttttctggacatcaaattgacccgtgataacaacataaccacgggaaaaatatatcagtcagtcattaacaaagaaaggagaggagactacttggggaaaaccattcaggttgtgccacatattacagatgaaattcaagattggattgaacgtgtagcgatgaatccggtcgatggtaaagaaggacctcctgatgtttgtgtcatagaacttggtggcaccataggggatattgaatcaatgccctttattgaagcattaggtcaattttcctaccgtgttggacctggaaacttctgtctggtccatgtcagtcttgttccagttttaaatgtagttggtgaacagaaaactaaacctacccagcatagtgttcgtgggctaagaggccttggattggcacctgacattttagcatgtcgcagtaccgagccactggaagaaaacgtgaaagcaaagctctcacaattttgtcacgttccagtctcaagtattattaatctccatgacgttacaaacatttggcacatccccttgttgctaagggaccaaagggcccatgaagctattctgaaagttctagaccttcaatttgtcggtaaagtaccacgagaacccaagttggttgaatggaccgaaagagccagcaagtttgacaagttgaaggctacggttaagattgcgatggttggaaaatatactgggctgtccgattcctacctgtctgttctaaaggcacttttgcatgcatcggttgctatgggaagaaagcttgtagtggagtgggttccttcctgtgatcttgaagattctgcagccaaagagacccctgaagcccataaaaaagcatggaagctactcaagggtgcagagggtatacttgtccctggaggctttggagatagaggtgttcagggaaaaattcttgctgcaaaatatgcacgagaaaataatgttccttatctcggcatttgcttgggtatgcaaattgcagtgattgattttgcctgttctatcatgaaattaccgggtgcaaatagcacagagtttgacccagatacaatgtcaccctgcgtcattttcatgccagagggttccaaaacccatatgggggcaactatgcggcttggatcaaggagaacatatttccatgccactgcatgcaaatctgcaaagctgtatggtaatgctagattcgtagacgaaagacatcgacacagatatgaggtaaatcctgaaatggtaccagagtttgagaaggccggactttcatttgttggcaaggatgagagtggaagacgcatggagattattgaactacccagtcataaatttttcattggagtacagttccatcctgaattcaagtcaagaccagggaagccatctccacttttcttaggattaatagcagcagcatctggacaactagaaactttgctccaaccaagttccaacattgtcaatccaaatcctatgcccagatttcccattcccaaaaagacgatttaccatgccaagaagccactggacagcttggtaaacggatactttgcaaatggcaacgtcatccacacttgattagcagttgtgcaaatcctaagcgaggccttgtttgagatttgtttctacggttttctgcttgaaccctaatcttttcttcttcttcgttttcgtgttttttttttggctttgtatttgtctctgctcaactgagaaggctaagagttgcaagctccagatacacggttcccatgttttaagaggaaacgtcctccggtcatgttgaagcaaagtttagctatagggtggtgtagtgtgctgtttatttcctgctgaggcctcaattaaggctggaaatgtattggtagctttagtatagcctggcatctcaactatttgtacattgggaaaaaaacctacctaagtactgaatatacaaatgcttggccaagattgcttacttcaatgaagagttgggcatctctgtatccttttcttttaacagcaggcgatctgagacatgaatatgct

SEQ ID NO: 1899 - DNA, 2537 bp, Sorghum bicolor
ctctatccccccagccgccttgcctccattgcctccccactcctcccttctcttccctctcacctcctaaaacctcgcttccccggtcgcacctccagctcgtgcgtccgtgcgagcgcgcggtttccttgccaagaactgtcgcgcgggtcgggggattgaggaggacggtgggcggcggcggcggcggcggatttgtcgggcccgagattcccggacaaggcgaaatgaagtacgtccttgtcaccggcggggtggtgagcggcctgggcaagggcgtcacggccagcagcatcggcgtcatcctcaaggcgtgcggcctccgcattacgtccattaagatcgatccttaccttaacaccgatgctggaactatgtctccattcgaacatggtgaagtgttcgtgctggatgatggtggcgaggtggacttggatcttggtaactacgagaggtttctggacattaaacttactcgggacaataatataaccaccggaaagatctatcagtctgtaattgacaaggagaggaaaggggaatacttgggaaagactgtccaggttgtgccacacatcacaaatgccatacaggagtggatcgagcgtgttgctatgataccagttgatggcaaggagggacctgctgatgtctgtgtgatagaactggggggcactataggtgatattgaatccatgccatttattgaagctttgggccagttctcttatcgtgttggtcctggcaacttctgcctggtgcacgtcagtctagttccagttttgaatgttgttggtgaacagaaaacaaagccaacccagcatagtgtacgtggtttgaggggactcgggctcaccccaaatattttagcttgccgcagtactaaggaattagaggataatgtgaaggagaaactctcccagttttgccatgtgccggcagcaaatattatctctttgtatgatgtttccaatatctggcgcattcctttgttgctacgggaccaaaaagctcatgaggctattcttaaagttctgaacctggaaagggtggatagcattgctcgagagccaaagttagacgaatgggttgcaagagctgctatatttgatacccttcatgacactgtgaggattgctatggttgggaagtacactggcttatcagattcatacctgtctgtgttgaaagccctcttgcatgcatctgttgattgccgcaggaagcttgttgttgattgggttgcttcaacggatcttgaggactccacggcagttgaggcacctgatgcatataaaacagcgtgggatttgttgaagggggcagatggaattttggtacctggtggctttggtgacagaggtgttcaagggaaaattttggctgctaagtatgcccgtgaaaagaatgtcccatatcttggtatatgtcttgggatgcagattgctgtggtggagtatgctcgtcatgtcatgaatctcaccgatgcaaacagcactgaatttgatccaaataccaagaccccttgtgttatttttatgcctgagggttccaaaacacatatgggtgcgacaatgcgcttaggatcaaggaggacatttttcaagattgctgattgcaagtcttctaaattgtatggcaatgtcacttatgttgatgaaaggcatcgccacagatatgaggtgaaccctgatatggttccagagttcgaaaatgctggacttcagtttgttggcaaagatgatactggaaggaggatggagattattgaaatacccaaccaccgatattttgttggtgcacaattccatcctgagttcaagtcaagaccttcaaaaccttcgcccctatttgtgggactaattgcggctgcatctgggcagttggatagggtgctgcaagactgctgcaatggtcatgttatttcagctaagcatgttctgagcaatggctcatatacacccacagtacaccaaaatgggcacccaaagaagctcgccaatggtctctcaaacggaacatactatgccaatggcaatggtgtgcatgcttagagcagcaggggatgatggatcaaggatttgcaactatttacttgaaaaagttcagttttgtcttggcggttcctaatgcatcagttttgtcttggctggcttgactatcatcatggtcgctcgaggaagaaaaagttcttgtgctcgatgcggactgtctgctggggatggtgctcgttcggtggtttttagttaaggaaccgagctgatctctttgaaggcgcgagatagtggtttctgcgttcgtctctaccctcctctgtaagcaaatggagcagatttgggtcagaagagtttacatgctgtatatcttaaagaaaagctgtatgttttggttacttaaattaggttttcagtgaggtctagagctgatgcttaaaaaagcgcagcagtgcaagagagtatttcgaaattaggtactttgatttgggacagttttttttgtgcttgtgcgcaaataagttgatgctctgctgcatgatc

SEQ ID NO: 1900 - DNA, 2485 bp, Sorghum bicolor
cttctaaactctgcccaccaccaccagcgcctgagagagcctgcctccactcttggtttggttggccccctggctggcggcaccacactagcctagtgagtagtgcagcagcggcagtcttgcttgctcggttgctcctactacctgtcctgcacactgcacaggagcagcagagcctagctaggaccgtcgtcgtcggcgaaaggggagcgggcggccatgaagtacgtgctggtgaccggaggggtggtgagcggcctcggcaagggcgtgacggccagcagcatcggcgtcgtgctcaaggcctgcggcctccgcgtcaccaccatcaagattgatccatacctcaacactgatgctggaaccatgtctccattcgagcatggggaggtgtttgttttggacgatggtggagaggtggacttggaccttggaaactacgagcgttttctggatatcaaattgacccgtgacaacaatataaccacaggaaagatctatcaggctgtcattaacaaagaaaggagaggtgactacctaggaaaaaccgtccaggttgtgccacatattacagatgaaatacaagattggattgaacgtgttgcaatggttccagtcgacggcaaagaaggacctcctgatgtttgtgtcattgaacttgggggcactataggggatattgagtccatgcctttcattgaagcattaggtcaattttcataccgtgttggacctggaaacttctgtctcgttcatgtcagtcttgttccagttctaaatgtagtcggtgaacagaaaactaagcctacacagcatagtgttcgagggcttagaggacttgggctggcaccggatattttagcatgtcgcagtaccgagccattggaggaacatgtgaaggtcaagctttcacaattttgtcatgttccgatctcaaatatagtgaacctccatgacgtgacaaacatttggcacatccccttgttgctaagggaccagaaggcccatgaagctattctgaaagttttagagcttcagtatgatggaaaagtacctcgggaacctgagttagcgaagtggactaaaagagccactaagttcgacaaattgaagactccggtcaagattgccatggttggaaaatacactggcctgtcggattcctacctgtctgtcataaaggctcttttgcatgcatcagttgctatggaaagaaaacttgtagtcgagtgggttccttcctgcgatcttgaagattcttcagctaaagagacccctgaagcccataaaaaagcatggaaattgctgaagggtgcagatggtgtactcgttcctggaggatttggagataggggagtccagggcaaaattcttgccgcaaaatatgcacgtgaaaacaatgttccttatctcggcatttgcttgggaatgcaaattgcagtgattgagtttgcccgttcggttatgaaactacgaggtgccaatagcacggaattcgatccagctacaacatcaccctgtgtcattttcatgccagagggctcaaaaacccaaatgggagcgacaatgaggcttggatcgaggagaacctatttccatgtcaatggatgcaaatctgcaaagctgtatggcaatgccagctctgtagatgaaagacaccgccacagatacgaggtgaaccctgatatggtcccggactttgagagggccgggcttcaatttgtgggcaaagatgaaagtggaaaacgcatggggataattgagcttccctctcacaagttcttcatcggtgcacaattccatcctgaattcaagtcgagaccaggaaagccatctccgcttttcttagggctgatagccgcggcatctggacagctagaacctttgcttcaacgcagcaatctgacaacaaaagcatgtcctatcagtaaaatcccgaaactgaaattatacccaactggacctgtgaatccattgaacagcttggtaaatgggtactacccaaatggcactggcattcacacctagaagcataatgcttagcagcggcttgattgatatttgatttgctcatatggttttgcttgtaccccctttttatgtttctttttcagtttgtactctgatcaactgagaaggctaagattcagcaagccctagctccagcgacacatggttccgacattttaacgaggaacgtcctccagtccgttgcagcaaactagctatagggtggtgaggtctagtgtgatgttgcttttttgttttgaggcctggaattaaaggcgggaagtgttttggtagcgttagtagagcctggaatctcaactatttgtacattatggaagaacttatctaaggactgaatatacaaatgcttggccatgattgcattgctgccaaaatattaacaaccacactcagataaagagtatgagtgtataactgtttaattaaaaaaatgcaagcaatattgttgttgtta

SEQ ID NO: 1901 - DNA, 2445 bp, Sorghum bicolor
cttggctggcccccaacccaacaaaaaaaaaaaaacccctctctctcccattcccatctcgcctcccacctcctccgcctcgccgcggcaggcaccgccgccagtcacctccgcctcccccctcccttcctcgactcgatcgcgtgcgtcgcacgaggtgacctcgctcactcgtcaggagatcgaccccaaccgactcgagcgcgacgccatgaagtacgtgctggtgaccggcggagtggtgagcgggctcgggaagggcgtgacggccagcagcatcggcgtccttctcaagtcctgcggcttccgcgtcacctccatcaagatcgatccatacctcaacaccgatgccggaaccatgtctcccttcgagcacggcgaggtgtttgttttggacgacggtggtgaggtggacttggaccttggaaactacgaacgatttctggacatcaagttgactcgtgacaacaacataaccacggggaagatctatcagtctgtcattgacaaggaacgtagaggagattacctaggaaaaactgttcaggttgtgccgcacatcacagatgaaatacaagagtggattgaacgtgtggcaatgaatccagttgatggcacagaagaggcagctgatgtttgtgtcatagaacttggtggcactataggggacattgaatcaatgcctttcattgaagcattaggtcaattttcataccgtgtagggcctggaaacttctgcttggtgcatgtcagtcttgtaccagttcttaatgtagttggtgagcagaaaacaaagcccacccaacatagtgttcgcggacttagaggacttggactcatgcctgatattttggcatgtcgtagtacacatccacttgaagaacatgtgaaagtgaagctcgcgcaattttgtcatgttccgataccaaatatcattaatctccatgatgtcacaaacatttggcacatccctttgttgctcagagatcagaaggcccatgaagctattttgaaagtgttagaccttcagtgtgtgggtaaagttgctcgagaaccccaattgtctgaatggactgaaagagccagcagatgtgacagattgaaaactccggttaggattgctatggttggaaagtatactggcttatcagattcctacctatctgttatcaaggctcttttgcatgcgtcagttgctttggacaggaaacttgtggtggactgggttccttcctgtgatcttgaagattctacagcagaagagactcctgatgcctatgaaaaagcatgggagtcgctaaagggtgcagatggtgtgttggtgccaggaggttttggagacagaggagtccaagggaaaattcttgctgcaaaatacgcgcgagaaaacaacattccatatcttggcatttgcttgggcatgcaaattgcagtgattgagtttgcacgttctatcatgaagttgcatggtgctaacagcacagagtttgatccaaccacaaaaacaccatgtgttattttcatgccagagggatccaaaacccatatgggggcaacaatgcgccttggatcaaggaggacctttttccaggtcactaactgcaaatctgctaaactgtatggcaatgttagctacattgatgaaaggcaccgccacagatacgaggtgaatcctgatatggtcccagaatttgagaaggcagggctttctttcgttggcagggatgaaagcggtaaacgcatggagattatcgaactaccaactcataggtttttcgttggtgtacaatttcaccctgaattcaagtcaaggcctggcaacccatctccgcttttcttaggattggtagcagcatcatcaggtcagcttgatcaacgtggcgttatcagtaagacaagcagatgcatcagcaataccggaggagcatcaaagctaaaagcttgccagaatgggcacctcatgaagccactgaagggcctggtgaacgggcactattcaacaaccagcaatggcgccattcccatctagcagcacagagctgcgaggcactgcatgcttgtttgagatttctcttctaccgttttcgcttgttcttttcctttacttggagcgtgttcttccattctaccaagcaaactaagaagaagagaagggccgtttgctctagcgacacagcagccgtttccgatgttttaacgtggaagcatttggcatgcaagctgtcgcatgcattaagaggcaaatttagcaggttagctagagtttgattagtagtagtaatccgatatgctggtttatttgttcgtttgtttgctaagattacaaaggctggtgatgtgcagctagctgtagtgtagcctgccgtctcgcctcatttgtacattgtaaaataactgctactctccattgactgactgaatggatgagtataaacgtatcggacc

SEQ ID NO: 1902 - DNA, 2333 bp, Saccharum officinarum
  misc_feature (1078)..(1078): n is a, c, g, or t
  misc_feature (1105)..(1105): n is a, c, g, or t
  misc_feature (1400)..(1400): n is a, c, g, or t
  misc_feature (1403)..(1403): n is a, c, g, or t
  misc_feature (2036)..(2036): n is a, c, g, or t
cagcgcctgagcctgcctccactcttggccccctggcctggcaccacactagcctagtgagtagtgcagcggcagtcttgcctgctcggttgctcctacctgtcctgcactgcacaggagcagcagagcctaggaccgtcggcgaaaggggagcggcggccatgaagtacgtgctggtgaccggaggggtggtgagcggcctcggcaagggcgtgacggccagcagcatcggcgtcgtgctcaaggcctgcggcctccgcgtcaccaccatcaagatcgatccatacctcaacactgatgctggaaccatgtctccattcgagcatggggaggtgtttgttttggacgatggtggagaggtggacttggaccttggaaattacgagcgttttctggatatcaaattgacccgtgacaacaatataaccacaggaaagatctatcaggctgtcattaacaaagaaaggagaggtgactacctaggaaaaaccgtccaggttgtgccgcatattacagatgaaatacaagattggattgaacgcgttgcaatgattccagtcgacggcaaagaaggacctcctgatgtttgtgtcattgaacttgggggcactataggggatattgagtccatgcctttcattgaagcattaggtcaattttcataccgtgttggacctggaaacttctgtctcgttcatgtcagtcttgttccggttctaaatgtagtcggtgaacagaaaactaagcctacacagcatagtgttcgagggcttagaggacttgggctggcaccggatgttttagcatgtcgcagtactgagccattggagaaacatgtgaaggtcaagctttcacaattttgtcatgttccgatctcaaatattgtgaacctccatgacgtgacgaacatttggcacatccccttgttgctaagggaccagaaggcccatgaagctattcttaaagttttagagcttcagtatgatgggaaagtacctcgggaacctgagttagggaagtggactaaaagagccaccaagttcgacaaattgaagactccggtcaagattgccatggntggaaaatacactggcctgtcggattnctacctgtctgtcataaaggctcttttgcatgcatcagttgctatggaaagaaaacttgtagtcgagtgggttccttcctgcgatctggaagattcttcagctaaagagacccctgaagcccataaaaaagcgtggaaattgctgaagggtgcagatggtgtactcgttcctggaggatttggagataggggagtccagggcaaaattcttgccgcaaaatatgcacgcgagaacaatgttccttatcttggcatttgcttgggaatgcaaattgcagtgattgagtttgcccgntcngtgatgaaactacgaggtgccaatagcacggaattcgatccagctacaacatcaccctgtgtcatcttcatgccagagggctcaaaaacccaaatgggagcgacaatgaggcttggatcgaggagaacctatttccatgtcaatggctgcaaatctgcaaagctgtatggcaatgccagctctgtagatgaaagacatcgccacagatacgaggtgaaccctgatatggtcccagactttgagagggccgggcttcaattcgtcggcaaagatgaaagtggaaaacgcatggggatcattgagcttccctctcacaagttcttcatcggtgcacaattccatcctgaattcaagtcgagaccaggaaagccatctccgcttttcttagggctgatagccgcggcatctggacagctagaacttttgcttcaacgcagcaatctgacaacaaaagcatgtcctatcaataaagtcccgaaactgaaattatacccaactggacctgtgaatccattgaacagcttggtaaatgggtactacccaaatggcactggcattcacacctagaagcataatgcttagcgatggcgcgatggcttgattgatatttgatttgctcctatggttttgctngtgcccccttttcatgtttctttttcagtttgtactctgatcaactgagaaggctaagtttcagcaagccccagctccagcgacacatggttccgacattttaacgaggaacgtcctccagtccgttgaagcaaaccagctatagggtggtgaggtctagtgtgatgttgcttttttgttttgaggcctggaattaaggcgggaagtgttttggtagcgttagtagagcctggaatctcaactatttgtacattatggaagaacttatctaaggactgaatacacaaatgcttggcc

SEQ ID NO: 1903 - DNA, 2509 bp, Panicum virgatum
gcctccattgccccccattaccttctcccccctcacctcctaaaacctcccctgcccccagcgccgcgcgctcgcgccgacaccgctgtgactgtgtgcgcgcgcggacgcgggcgctgccgcggactgtcccgtgggaccagggattgaggaggggggcggcggcagcgtgggatttgtccagtccgagattcccggtcgaggcgagatgaagtacgtcctggtcaccggcggggtggttagcgggctcggcaagggcgtcacggccagcagcatcggcgtcgtcctcaaggcgtgcggcctccgcattacgtccatcaagatcgatccttaccttaacaccgatgctgggactatgtccccatttgaacatggcgaagtgttcgtgttggatgatggtggcgaggttgacttggatcttgggaattacgagagatttctggacattaagctgactcgggacaataatataaccactggaaagatctatcagtctgtaattgacaaggagaggaagggggaatacttgggaaagactgtccaggttgtgccacacatcacaaatgccatacaagaatggatcgagcgtgttgccatgataccagtggatggcaaggagggaccagctgatgtctgcgtgatagaactggggggcactataggggatattgaatctatgccttttatcgaagctttgggtcaattctcctatcgtgttggtcctgggaacttctgtttggtgcatgttagtcttgttccagttcttaatgtcgttggtgagcagaaaacaaagccgactcagcatagtgtacgtggtttaaggggacttgggctcaccccaaatattttagcttgccgcagtacaaaggaattggaggataatgtgaaggagaaactctcccagttctgccatgtgccggcagcaaatattgtcacattgtatgatgtttccaatatatggcgcattcctttgttgctacgggaccaaaaggcacatgaggctattcttaaagttctgaacctggacagggtggaaagcattgctcgggaaccaaagttagatgagtgggttgaaagagctaccatatttgatgcccttcaaaacactgtgaggattgctatggtggggaagtacactggcttatcagattcatacctctccgtgttgaaagccctcttgcatgcatctgttgattgccgtaggaagcttgttgttgattgggttgcttcaacggatcttgaggactccacggccattgaggcacctgatgcatataaagcagcgtgggacttattgaagggggcagatggaattttagtaccaggcggctttggtgacagaggtgttcaagggaaaattttggctgctaagtatgcccgtgaaaagaatgtcccgtatcttggtatttgtcttggaatgcagattgctgtggtggagtttgctcgtcatgtcatgaatctcactgatgcaaatagcactgaattcgatcctgataccaagaccccgtgtgtaatttttatgcccgagggttccaaaacacatatgggtgcgacgatgcgcctaggatcaaggagaacatttttcaaggttgctgattgcaagtctgctaaattgtatgggaatgtcacatatgtcgacgagaggcatcggcacagatatgaggtgaaccctgacatggttccagagtttgaaaatgctggtcttcaatttgttggcaaagatgatactggaaggaggatggagattattgaaatacccaaacaccgatattttgttggtgcacaattccatccggagttcaagtcaagaccttcaaagccatctcccctatttgtgggactagttgcggccgcatctgggcagttggatagggtcctgcaagactgctgcaacggtcatgtggtcccagctaaacacattctaagcaatggctcttacccttctatagtacaccaaaatgggcatcctaagaagctcgccaatggtctttcaaatggaacatactatgccaatggcaatggtgtgcatgcttagagcatcagtggagggccccaaggatttgcaactatttgcttcaattttgcatttctcgttgcatcagttttggcatggctggcttaactatatcatggtcgctcgagaaagaaaaagttctttactcgatgcagactgtctgcaggggatagtgctcgttcggtggtttttagtgaaggaaccgagctggatctctttgaaggcgtgagatagtggtatccgtgttcatctctaccctcttctgtcagcaaatataacagatttgggtcagaagagtttttatgctgtatatctgaaagaaaggctgaatgttttggttgcttaatagattttcgatgagttctaaagttgacactgggaatgcactgtagtgggtgagagaatttcgatcttaggcactctgtatttggatattggacagttttttgtgctcttgcgcaaataagttaatgctctgcatgatattggttctgc

SEQ ID NO: 1904 - DNA, 2365 bp, Panicum virgatum
ctctgccgagcgcctgagcccgcctccagctccccgccccttggcaccacactatagcctagtgcctactagctcgcttgctcctccctgttgtccgcaggagcagagccaaaaaacccgtcagctcggcggcaagaacggccatgaagtacgtgctggtgaccggaggggtggtgagcggcctcggcaagggcgtgacggccagcagcatcggcgtcgtgctcaaggcctgcggcctccgcgtaaccaccatcaagatcgacccctacctcaacactgatgctggaaccatgtctccatttgagcatggcgaggtctttgttttggatgatggtggagaggtggacctggaccttggaaattatgaacgttttctggatatcaaattgacccgtgacaacaatataaccacaggaaaaatctatcaggctgtcattaacaaagaaagaagaggtgactacctaggaaaaaccgtccaggttgtgccacatattacagatgaaatacaagattggattgaacgcgttgcaatgaatccagttgatggcaaagaaggaccacctgatgtttgtgtcattgaacttggcggcactataggggatattgagtcaatgcctttcattgaagcattaggtcaattttcatatcgtgttggacctggaaacttctgtttggttcatgtcagtcttgttcctgtcctaaatgtagttggtgaacagaaaacaaagcctacacaacatagtgttcgagggcttagaggacttgggttggcaccagatgttctagcatgtcgcagtactgagccattggaagagcatgtgaaagtcaagctctcacaattttgtcatgttccgatctcaaatattgtgaacctccatgacgtgacaaacatttggcacatccctttgttgctaagggaccagaaggcccatgaagccattctgaaagttttagagcttcagtatgctggaaaggtacctagggaacctaagttggcggagtggacagaaagggccaccaaatttgacaaactgaagactccggtcaatattgccatggttggaaaatatactgggctatcagattcgtacctgtctgttctaaaggctcttttgcatgcatcagttgctatggaaagaaagcttatagtcgactgggttccttcatgtgatctggaagattcttcagctagagagaaccctgaagcccacaaaaaagcatggaagctgctcaagggggcagatggtatactcgtccctggaggctttggagataggggagttcagggcaaaattcttgctgcaaaatatgcacgtgaaaacaatgttccttatctcggcatttgcttgggaatgcaaattgcagtgattgagtttgcccgttcggtcatgaaattatgtggtgctaatagcacagaatttgacccagctgcaacatcaccctgcgtcattttcatgccagagggctcaaaaacccatatgggcgcgacaatgagacttggatcaaggagaacatatttccatgtcaatggctgcaaatctgcaaggctgtatgggaatgccacctctgtagatgaaaggcatcgccacagatacgagctgaaccctgatatggtcccagactttgagagggccggacttcaattcgtgggcaaggatgaaagtggaagacgcatggagatcattgaactgccctctcacaagttcttcatcggcgcacaattccatcctgaatttaagtcgagaccaggaaagccgtctccacttttcttaggtctgatagcagcggcatctggacaactagaacctttgctccaacgcagctgcaacaatctgccaaagacacatgtgaacaacggtaaagtccagatacggaaactgtacccaactgtacctgtgaagagtccattaaccagcttggtaaatgggtactacccaaatggcaccggcattcacacctagaagcataaacactaagccaaggcttgattgatatttgctcctaccgttttgcttgtaccccttttcatcttcctttttggtttgtatttgtctctgatcaactgagaaggctaagattcggcaagcccggcccggcccggccccagctccagcgacacacggttccgacattttaacgaggaacgtcctccggtccgttgaagcagactagtagctgtagggtggtgagttctagtgcgcgcgcgtgatgtttcctttttgtttgaggcctataattaaggctggcagtgtcttggtagcattagtagagcctggaatctctcaactatttgtacaatgtacattatggaagaacttatctaaggattgaatacacaaatgcttggccatggttgcgttgccgt

SEQ ID NO: 1905 - DNA, 2490 bp, Panicum virgatum
gcaaaaaaaaacttccatctcccgcctccgcctccgcctccgcctcggcaggcactgccaatctcctctcccctctccctctccctctccctcctcgatcccaaggcgagagaccagggaacccgcgacgaccgcgcgcacgagccgctgcagtgagtgacctcgcaacccgcgcgcgtgagaggggagatcgagcagaaggtgccgggacccgaccgagccgaggactcgagaccatgaagtacgtgctggtgaccggcggcgtcgtgagcgggctgggaaagggcgtgacggccagcagcatcggcgtcctgctcaaggcctgcggcctccgcgtcacctccatcaagatcgatccatacctcaacaccgatgcaggaaccatgtctccgttcgagcatggcgaagtgtttgttttggacgacggtggtgaggtggacttggaccttggaaattatgaacggtttctggacatcaagttgactcgtgacaacaacataaccacgggaaagatctaccagtctgttattgacaaagaacgtagaggagattacctgggaaaaactgttcaggttgtgccacacatcacagatgaaatacaagtgtggattgaacgtgtcgcaatgaatccagttgatggcacagaagagccagctgatgtctgtgtcatagaacttgggtggcacaataggagacattgaatcaatgccttttcattgaagcattaggccaattttcatatcgtgttgggcctggaaacttttgcttggtgcatgtcagtcttgtaccagttctaaatgtagttggtgagcagaaaacgaagcctacccaacatagtgtccgaggactaagaggacttggactccttcctgatattttggcatgtcgcagtactcagccacttgaagagcatgtgaaggtgaaacttgcacaattttgccatgtcccgataccaaatatcattaatctccatgatgtcatgaatatttggcatatacctttgttgctcagggatcagaaggcccatgaagctattctgaaggttttagaccttcagtgtgtgggaaaagttcctcgagaaccaaaattggccgaatggactgatagagccagcaaatgtgacaaattgaaaactccagttaggattgctatggttggaaaatatactggtctatcggattcgtacttgtctgttttaaaggctcttttgcatgcatcagttgctttgaacaggaaacttgtggtggattgggttccttcctgtgatcttgaagattctactgcagaagagagtcctgatgcctatgaaaaagcatggaagtcactgaagggtgcagatggtgtgttggttccaggaggtttcggagacagaggagtccaagggaaaattttggccgcaaaatatgcgcgtgaaaacaacgttccgtatctgggcatttgcttgggcatgcaaattgcagtgattgaatttgcacgttctatcatgaagttgaatggtgctaacagcacagaattcgatccaaccacaaaaacaccatgtgttattttcatgcctgagggatccaaaacccatatgggtgcaacaatgcgcctgggatcaaggaggacctattttcagggcaataaatgcaaatccgctaagctgtatggcaacgctagctatgttgatgaaaggcaccgccacagatacgaggtgaatcctgatatggtcccagaatttgagaaggcagggctttctttcgttggcagggatgaaagcgggaaacgaatggagattattgaactgccaactcataggttttttgtcggcgcacaatttcatcctgaattcaagtcaaggcctggcaaaccatctccacttttcctaggattgatagcagcagcatcgggtcagcttgatcacctgcttcaacgcccctgcggcgttttcagtccaacaggcagatgcagctgtttttccaacggaactcagaatctaaaagtgtacaagaacgggcacgtcataaagccactgaagggcctggtgaacgggcactatcctgcaaccggcaacggcgccattcccatctagcagcacaacggtgcaaggcgccaggttgtttgagatttcccttctaccgtttctgcttgaatttttttcccctttctcccttcgcgcgcgttcttcaattctaccagtccaactaaagaaaagggctgtttgctccagcgacacggcgagccgttccgatgttttaaaggaagcatttggcatacaagatgtcgcgttgagaggcaaatttagcaggttagctagggtttgattagtagtggttatctgatatgctggcttattctgtttgttcgtttgtttgctaagattacaagggccggtgatgtgcaactagctgtagtggagcctgccatctcgcctgattgtacattgtaaaacaactgctactctccatgtactgtatcgatggatgagtataaaaaaaaagttatgggacc

SEQ ID NO: 1906 - DNA, 2385 bp, Triticum aestivum
tccaaaccaaaaacctcgccacttcctcacccctcccctcccctcccccattctccgagcccccaaagaaggcggcagcagcacgagctagccagctgccagtgcagtgaccggccggcggtttgggaagctcccgcgcgtgtacgtgggcatgaagtatgtgctggtgaccggcggcgtggtgagcggcctgggcaagggcgtgacggccagcagcatcggcgtgctcctcaaggcctgcggcctccgcgtcacctccatcaagatcgatccctacctcaacaccgatgccggaaccatgtcccccttcgagcacggcgaggtcttcgtcctcgacgacggcggcgaggtggacttggatcttggaaattacgagcggttcctggacatcaagctgactcgcgacaacaacataaccactggaaagatctaccaggctgttattaacaaagaacgaaaaggagactacctgggaaaaactgttcaggttgttccgcacattaccgatgaaatacaagactggattgaacgtgtggcgatgaatccagttgatggcacggataagccagctgatgtttgtgtcatagaacttggtggcactataggggacatcgaatcaatgccttttatcgaagcattgggtcaattttcgtaccgcgtaggagctggaaacttttgcctggttcatgttagtcttgtaccagttctaaccgtagttggtgaacagaaaacaaagcctacccagcatagtgtccgtggactaagaggacttgggttgatgcctgatatcttggcatgccgcagtactcagccactggaagaaaatgtgaaactgaaactctcgcagttttgccaagttccggtttcaaatatcgttaatctccatgatgtaacaaacatctggcacatccctttgttgctcagggatcagagagcccatgaagctattttgaaggttctgggcctttggtgtgtggggaaagtgcctcaagaacctaagttgtctgaatggactgaaagagccagcagattcgacaaactgaaatctccggtcaggattgccatggttggaaaatataccggcatatcggattcctacctgtctattttgaaggctcttctgcatgcgtcggttgctttggacaggaaactggtggtggactgggttccttcctgtgatcttgaagattctgctgctgtagagacgcctgatgcctatgaaaaagcatggggtctactaaagggtgcaaacggcgtactagttccgggaggctttggagacagaggtgtccagggaaaaattcttgctgcaaaacatgcgcgagaaaacaacgttccgtatctcggcatttgcttgggcatgcaaattgcagtgatcgaatatgcacgttctgtcatgaagctgcgtgatgctaatagcacggagtttgatccagctgcaaaaacaccatgtgttatcttcatgccagagggctccaaaactcacatgggcgcgacgatgcgccttggttcaaggaggacatttttccaggtcaacaactgcaaatctgctaaactgtatgccaatgctaactatgtagacgaacgacaccgccacagatacgaggtgaatcctgacatggtctcagaatttgagaaagcagggctttctttcgtgggcagggatgaaagcgggagacgcatggagattattgagctaccaactcataagtttttcgtgggcacgcaatttcatcctgaatttaactctaggcctggaaagccatcaccacttttcttaggattgatcgctgcatcatctggacagctagagcacctgcttcagcgtacttccggtgctgtcagctcaccgaccaggtgcatcgccggtcccggagcccctaagacgaagttaaggatgaacggcctggtgtcgacgtacttcgcgaatggcagcagtattcacatctagcagcacggcagcagatcagtatttttctttttcttttcctgcatgtgtttttcttttcttttttatcttctttagtatggatctatctctctgatcaagcaagaagagatcggcagctccagcgacacgacgagccgtttccgggtttttatgaagggaactatttggggtcgcgcggaagcaaaattagctagggtttattagtgctgctctagttccgcttgctattcctttcgcttgttcgtttgtttctttaaggattttattatcaaggttgtaaggctggggatgtgcagctagcttcagtttcaagcctgccgtctcgcctgcttgtacattgtaaaacagaaccgctgctctccagtgactgaatgattataagcagctactgtagtagtatttgggaaaaaaatatgtaccaaactgttcggatc

SEQ ID NO: 1907 - DNA, 2427 bp, Triticum aestivum
  misc_feature (549)..(549): n is a, c, g, or t
  misc_feature (597)..(597): n is a, c, g, or t
  misc_feature (612)..(612): n is a, c, g, or t
  misc_feature (699)..(699): n is a, c, g, or t
  misc_feature (735)..(735): n is a, c, g, or t
  misc_feature (762)..(762): n is a, c, g, or t
  misc_feature (1128)..(1128): n is a, c, g, or t
  misc_feature (1173)..(1173): n is a, c, g, or t
gctctatcccctgcgcctccattgcctcccccccggttccttcctcctcccctcccaaacggctgcgcgctaccccagtcacctgctaaaaccttctccactgtccgcgtgcgagcgctcataaacagagcacgcgcgccagccgggcttgggtgcagaaggattcgggaggaggaggcggcggcagcggcggcggcggcggagattcccggcgagatgaagtacgtgctggtcaccggtggtgttgtgagcggcctcggcaagggcgtcacggccagcagcatcggcgtcgtcctcaaggcgtgcggtctccgcattacgtccatcaagatcgatccttacctcaacactgatgctgggactatgtccccgttcgagcacggtgaagtgtttgtgttagatgatggtggcgaggtggacttggatcttgggaattatgagaggtttcttgatattaaactcacccgggacaataatataactactggaaagatctaccagtctgttattgacaaggagaggaaaggggaatacctgggaaagactgtncaggttgtgccacacattacaaatgccatacaagactggatcgagcgngttgctatgataccngtggatggcatggacggaccagctgatgtctgtgtgatcgaactgggtggaacaattggtgatattgaatctatgccatttattgangctttgggtcaattctcgtatcgtgttggacctggnaacttctgtttggtgcatgtcagtctngttccagttctgaatgttgttggtgaacagaaaaccaagccgactcaacacagtgtgcgtggtttaaggggacttggcctcaccccaaatattttagcttgtcgcagtacaaaggaactggaagaaaatgtcaaagagaaactctcccagttctgccatgtgccggcaacaaacattgtcactctgtatgatgtttccaatatttggcgtattcctttgttgctacgggaccaaaaggcgcatgaagctattcttaaagttctgaaccttgaaagctttcctcgtgagccaaagttggatgaatgggttgcaagagctactatgtttgacacccttcaggatactgtacgcattgctatggttggnaagtacactggtctatctgattcctatctctctgtgttgaaagcnctcttgcatgcttcagtttattgccacagaaagcttgttgttgattgggttgcttctacagaccttgaggactctaccaaaattgaggcacctgatgcttacaaagcagcttggaatttattgaagagtgctgatggcattttagtacctggtggctttggagatagaggcgttcaaggaaaaattctggctgctaagtatgcccgtgaaaacaatgtaccatatcttggtatatgtcttggaatgcagatggctgtcgtagagtttgctaggcatgtcatgaatctccctcatgcgaacagcactgaatttgaccccaatgccaagaccccatgtgttatttttatgcctgagggttccaaaacacatatgggtggcacaatgcgcctaggatcaaggaggacattcttcaaggttgctgattgcaagtcagctaaattgtatggaaatgcggactatgtcgatgagaggcaccggcacagatatgaggtgaatcctgatatggtgccagaatttgaaaacgctggacttaagtttgttggcaaagatgagagtgacaggagaatggagataatcgagatacccaatcaccagtatttcgttggcgcacagtttcatcctgaattcaagtcaagacctgcgaaaccttctccactatttgttggcctaatcgccgcctcatctgggcaattggacaaagtgctgcagggctgctccaatggccatgtgattcctggcaaacatcaattcagcaatggtccatacacgccggctgcacaccaaaacacaaacgggcatgcgaagaagcttgccaatggtgtagcgaatggaacatactatcccaatgggaatggtgtccatgcctagcaagttcaaggatgttctcaccctccttttttacatttttgcagttggttgttgaatcagttttgtcgtggctggctaagctaccatggtcgctcgaggaagaaaaagttctgtactcgatgtggactgtctgcaggggattgtgctcgttcggtggtttttagtgaaagaaccgagctggatctgcgtgagtggtgtgcttcttctcttctctaccaatttctgtaacaagacagcagaagtaggtaagaagagtttccgtgctgtatatctgaaaaaggaaaggctggacgttgtatttgtttcgagagttggtgttgagatgtaagcgaatttgggtgttcggcagtttgtatttggacgcggttttgtgctttgcacaaataa

SEQ ID NO: 1908 - DNA, 1974 bp, Brachypodium distachyon
atggacggcgccgggggcggcggagggttgcacggcgcccggaggaacatctcatcggcctccgggcccaggagaagggccctgcctatggagaacgggcacgacgccccctcttcggccaggaggccggcatccgcctccttctcccgcaccacatcgtcgatggccgcggagagaaccgtcaagagactgagactgtcaaaggcgctaacaataccagatcacacaaccgtgtacgaggcttgtcggaggatggccgcacgtagggttgatgctgtgttgctaacggactccaatgctttgctctgcgggatccttactgacaaggacataaccacaagggtgattgctcgtgaattgaagctagaagacacaccagtttctaaggtcatgactagaaaccccctctttgtgctgtcagacactcttgcagttgaggcattgcaaaagatggtgcaaggtaaattcagacatttacctgttgtggagaatggtgaagtcattgcactgctggacatagccaagtgcctatatgatgctattgcacgaatggaaagggcagcggagaaaggaaaagcaattgctgctgctgttgagggtgtagagaagcattggggaacagccgtatctggtcctaacacttttgttgaaactcttcgagagcggatgtttaggccatcactgtccaccatcatatccgagaattcaaaagtggtcactgttgcaccaacagacaccgtgttgacagcatcaaaaaagatgcttgaactaaaagtaagttcagcagttgttgcaattgaaaacaagcctggtggaattctgacctctagagatatattgatgcgtgttatagcccaaaatcttccacctgagtctactacagttgagaaggtcatgactcagagtccagaatgtgccacaactgacactccaattcttgaagccctacatacaatgcatgatggaaaatttcttcatttgcctgttctagacagtgatggaaatgttgtaactgttatcgatgtccttcacataactcatgctgcaattgcgacggtcggaaacagtggggctgccggctctgaggcgacttcttctatgatgcagaggttctgggattcagcgatgtcaagtggacctcttgatgatgacgatgactccagaagtgaaggatcaacgaaagttgcatccgaggcaacagatattggaagatcaaccttttatccggcttctggcttatcaagcacttttgggttcaagattcaggacaagcaaggcaggatgcatagatttaactgtgataccagcagcctgacagaactgataacttccattctacaaaggcttggcgatgacattgataaactgaacctacctcaaattttgtacgaagatgaggatcgtgataaggtcatactttcatcagactctgaccttatagcagccgtggaccatgcgagacaaatcggttggaagagtttaaggttgcacctggattacgccggcgtgggccgccggaagagaacttccggctccacgaatttcgagtacgccggaagggacgcatgggcttccgcctacagcaccgttgccgcgggggcggccctcgtcgctggccttggcgtgatggcttacctgaaaagagcgagctaggcgcctcgatgacacacatgttactttcgttgaaatgggcagaagaatggactctctgaagaaagaggaaaagaaaaaatatgccagaatggctgtgtgtaattcttgtgagaaaatcaaccaggatctgtaataatgccacggcagtggatgactggacagcccgcagacggtgtcgatcaattcttggctatccattccagccccgaagtctccaaactctccatggctggccacgactgtactataccataaacacatgatcaccattgtacaatgaaacataattggccatttttgtttgagaaaaccagcgtgccc

SEQ ID NO: 1909 - DNA, 2303 bp, Zea mays
gcctctcgtcgacacgaatgcgcaaagcaaacaccacgcgggccaggccaggcgcgcacgcacgggacgggggcatccgaacaccaccacccagcacccaccagctcggcgaaaaaaaagaaggaaaattttagataccctgccgcacgccgcgaccttcggccccgtctccggtctccgccttcccccacctattggggagcgctcctgattcgcgggagccagcgggcgagacaaagagaatcccccgctcctgcgccgccgcggatcagcgccgtcgccgatcggaggctctcgcttcccccggcgggcggcgcgcgccgggagatggacggcggcgcgggcgcgggcgccggccggaggaacgtctcatcgtcctccggatccaggaggagggtcctgcccgccgagaacgggcacggccatgacgccccgccgccctccaggcggtcctccgtctccctctcccgcggccactccacgtcactgaccggcgagaggaccgtgaaaaggctgaggctgtccaaggcgctgacgataccggatcacacaaccgtgcacgaggcttgtcggaggatggcgtcacgcagggttgacgccgtgctgctgactgactccaacgctttgctctgtgggatcctcaccgacaaggacataaccacaagggtgattgctcgtgagttgaagatggaagagacaccggtctccaaggtcatgacccgaaaccctgtatttgttctcgcggacacgcttgcagtcgaggcgttgcaaaagatggtgcaaggtaagttcaggcatctgcctgtcgtggagaatggcgaggtcattgcaattctggacatagccaagtgcctatatgatgctattgcacggatggaaagggcggcggagaaaggaaaagcaattgccgctgccgtcgagggcgttgaaaagcattggggagcagctgtgcctggtcctaacaattttattgagacgcttcgagaacggatgtttaggccatcgctgtctactattatctctgagaatccaaaagttgtcactgttgcaccatcagacatggtgttgacagcatcaaagaagatgctggaattaaaagtgagttcagcagttgtagcaattgaaaacaaacctggaggaattctgacatctagagatatattgatgcgtgttatcgcccaaaatcttcctcctgagtccaccacggtcatgactcagagtcctgaatgtgccacagtggacaccccaattcttgatgctcttcacacaatgcatgatgggaaatttttacatttgcctgtcctggacagggatggaaatgttgtgactgttgttgatgttcttcacataactcatgctgcaattgctacggttggaaacagcggggcagctggatccgaggcaacatctgccatgatgcagaggttctgggattcagcaatgtccattggacctattgatgatgacgatgactcgagaagtgaagggtcgactagagtggtatctgaggcaacagatataggaagagcagccttctttccagcttctggcttatcaaacacttttgggttcaagattcaggataagcaagggaggatgcacagatttaactgtgaaacaagcggcctggcagagctgataaccagcattcttcagagggtcggcgacgacattgacagaaaacacctgccgcaaattttgtacgaagacgaggaccgtgataaggtcgtgctttcgtcggacagtgaccttatagccgctgtggaccatgcgagaaagatcggttggaagagcataaggttgcatctggattacgccggcgttggccggcggaagggagggggtggtccttcggacttggagtacgctggcaaggacgcagcatgggcttctgcgtacagcgcggtcgcggcaggggcggctctggttgctgggctcggtgtgatggcctacttgaaacggtcggggtaaaagcttggaggcgaagagcacgacggcagagggagcacacgcttctcatcggatctgtgtgatacaaatgatactgcgtcggaacgagcagaatggctgtgtaagtaattcttgtgaaaaagagagagagagagagggagattttaataatactactgtcaaggcagtgaatggccgcctgcatacgagggagtacacggaactggtcgagcctttttggtgggttcagagtctccacgactaatttaccacggctgttagcgtcgtcacgattgtatttgtatcataaatcacacgatcattatacaagaagagtcttgttgagcctcacc

SEQ ID NO: 1910 - DNA, 2352 bp, Oryza sativa
ggaaaaaaaaaattcagccgcgagcccgcagcctccggtcgcctcctccgccatctactcggagctcccggatcgaggggagcgctcgccgccgccgcagcgacctcgccggatcacggcggcgggggccgatcgatcggaggtcggtcgattgccttcggcgggtgggagatggatggcggcgtgggaggcgcgcacagctcgcggaggagcgtgtcctcgtcgaccggatccaggaggagggccgggcccacggagaacggccaccacgacgccgccgctgccgccgccggcaggaggtcctccgcttccatctcccgcgcctcgcagcagtcgatgaccggggagaggaccgtgaagaggttaagattgtccaaggcactgacgattccggatcacacaaccgtctacgaggcttgtcggaggatggctgcacgcagggtggacgctgtgttgctgaccgactccaatgctttgctgtgcgggatccttactgacaaggacataaccacaagagtaattgctcgcgaattgaagctagaagagacacctgtttcaaaggtcatgacaagaaatcctctctttgttctgtctgacacactcgcggtcgaggcattgcagaagatggtgcaaggtaagttcagacatttacctgtcgtggagaacggtgaagtcattgcactgctcgacatagccaagtgcctgtatgatgctattgcgcgaatggaaagggcagccgagaaaggaaaagccattgctgctgctgttgagggtgtagagaagcactggggagcttctgtgtctggtcctaatacttttattgagactcttcgagagcggatgtttaggccatcactatctaccattatttctgagaattcaaagtagagtggtgactgttgcaccaactgacacagtgttgacggcatcaaaaaagatgcttgaagttaaagtaagttcagcggttgtagcaattgaaaacaagcctggggggattctgacctctagagatattttgatgcgtgttatagcccagaatctcccacctgaatctactactgttgagaaggtcatgacccagactcctgaatgtgccacggttgacactccaatccttgatgccctccatacaatgcacgacggaaagtttttacatttgcctgtcttagacaaggatggaaatgttgtaactgtagttgatgtccttcacataacccatgctgcaattgcaactgttggaaacagcgcgggatctggatctgaggcgacatcagctatgatgcagagattttgggattcagcaatgtccattggacctcttgatgatgatgatgactccagaagtgaaggatcaactaaagtggcgtctgaggcaacagatgtaggaagatcagctttttatccggcttctggtttgtccaacacattcgggttcaagattcaagacaaacaaggcaggatgcacagatttaactgcgaaacgagcagcttgacagagttgataaccagcattctacagaggcttggcgatgacatcgatagaaaaaacctaccacaaattttgtatgaagatgaggatcatgataaggtcatactttcatcggacagtgaccttgtagctgctgtggaccatgcaaggcaaatcggttggaagagcttgaagttgcacttggattacgccggtgttggtcgccggaagagaggcggtggtggcacttcagacttcgagtacgctggaaaggatgcgtgggcttcagcctacagcgctgtggctgcaggagcagctcttgttgcaggccttggcgtgatggcttacctgaagagagcaggctaggcttgcagctttgcagttgcagatgcagatgcagatgaggctttcatcttgtgatgatgatgatacgaaatgttacagaatcaaatttgagcagattggtgtgtaaattaattcttgtggggaaaaaaatctgtaataatctcacggcagcggatggctgcctacatataatgacgaaattttccggtggctaaaaaaatgtctggtattcagcttgtatcgccactgtacaatgaagcaaatgctctgtactatgtgttgggacagtgtgaattcttttgccgtttgctcgtttgacaacacaccatgtgtccgtctgcaaattcaaagcccttctggcaaaaacaatggaacgaggcctataataactggtgttggtagtaacaatttgcagcagctattcaagtacagatgtttcatgtaaatgcacagaaatgtatatggttgatctgatcgattcgttggaaaggcgttatgtcgtgtgaccggcgccattgccgccggtggcattcatgatt

SEQ ID NO: 1911 - DNA, 2258 bp, Sorghum bicolor
ctgatccagctttctattccacccgcaccagcagcatctcggggaaaaaagaggaaaattttggagaaaattcccattggcccagaatactcaggcgcacgccgcgaccttcgctcccgtctccggtctccgcctgctccccgttcccccaactatcgggagcgctcccgatttgcgggagccacagagggagagagggcccctccgctagccgccgccgcggatcagcgccgtcgccgatcggaggccctcgcttcccccggcgggcggcgcgagccgggagatggacggcggcgcgggcgcgggccggaggagcgtctcctcgtcctccggatccaggaggaggctcccgcccgccgagaacgggcacggccatgacgccccgccgccctccaggcgcgcctccgtctccctctcccgcggcccctccacgacactgaccagcgagaggaccgtgaaaaggctgaggctgtccaaggcgctgacgataccggatcacacgaccgtgcacgaggcttgtcggaggatggcatcacgcagggtcgacgccgtgttgctgaccgactccaatgctttgctctgtgggatccttaccgacaaggacataaccacaagggtgattgcccgtgagatgaagatggaagagacaccggtctctaaggttatgacaagaaaccctgtatttgttcacgcggacacgcttgcagtcgaggcgttgcaaaagatggtgcaaggtaagtttagacatctgcctgttgtggagcatggtgaagtcattgcaattctggacatagccaagtgcctatatgatgctattgcacggatggaaagggccgcggagaaaggaaaagcaattgctgctgctgctgagggcgttgaaaagcattggggagcagcagtatctggtcctaacaattttattgagactcttcgagaacggatgtttaagccatcactgtctaccattatctctgagaatccaaaagtggtcactgttgcaccatcagacacagttttgacagcatcaaagaagatgctggaattaaaagtgagttcagcagttgtagcaattgaaaacaaacctgggggaattctaacatctagagatatattgatgcgtgttatcgcccaaaatcttcctcctgagtccactacagtcgaaaaggtcatgactcagagtcctgaatgtgccacagtggacatgccaatccttgatgctcttcacacaatgcatgatggaaaatttttacatttgcctgttctggacagggatggaaatgttgtgactgttgttgatgttcttcacatcactcatgctgcaattgctacggttggaaacagcggggcagctggatccgaggcaacatctgccatgatgcagaggttctgggattcagcaatgtccattggacctcttgatgatgatgatgactcgagaagtgaaggatcgacaaaagttgcatctgaggcaacagatataggaagatcagctttctttccagcttctggtttatcaaacacttttgggttcaagattcaggacaagcaagggaggatgcacagatttaactgtgaaacgagcagcttgacagacctgataactagcattcttcagagggtcggtgatgacattgacagaaaacacctgccacaaattttgtatgaagatgaggaccatgataaggtcatcctttcgtcggacagtgaccttatagctgctgtagaccatgcaagacagattggttggaagagcttaaggttgcacttggattatgccggtgttggccgccgaaagagagggggtggttcttcagacttcgagtacgctggcaaggacgcatgggcttctgcttacagtgcagtcgcagcaggggcggctctggttgctgggcttggtgtgatggcctacttgaaacggtcagggtaagctgggaggcaagcacggcatggaagtggaacacgcttttgatcgtctttgtgatacaaatgctactccaccggaatgagcagaatggctgtgtaagtaattcttgtgagaaacagagagaagaggaagattttaataatactgtcaaggcagtggatggccgcctgcaaacatgtacacggaattggtcgagttttttttggtgggttcagagtcaacgtcgtcacgatgtatttgtatcataaatcacatgatcattatacaagagtcctgatgaaccttcctcaggcatcgtctccttgtgcaaattctcagtgtttgttgagcctca

SEQ ID NO: 1912 - DNA, 2218 bp, Panicum virgatum
ggaaaatctttttccattggccgagaaaaactcagccgcaggccgcgaccttcgcttccgtctccggtctccgcctcccccattcccccgacccccatcttgcgggagctcccgattcgggggaggaggcaccgcaccccgccgccgccccccgcctgcggatcagcgccgtcgccgatcggaggcccctcgccttcccccggtgggcggcgcgcggtgggaggatggacggcggcgcgggggcggccgggcacggcggccccggccggaggaccatatcctccgccgccgcctccaggaggaggctcccgcccgccgagaacggccacggccacggccacgacggcgccgcctccaggaggtcctccgcctccatctcccgggccaactccccgtcactgactggcgagagaactgtgaaaaggctgagattgtccaaggcgctgacgataccggatcacacaaccgtgcatgaggcttgtcggaggatggcctcacgcagggtcgatgccgtgttgctgactgactccaatgctttgctctgcgggatcctcactgacaaggacataaccacaagggtcattgctcgtggattgaagatggaagagacaccagtctccaaggtcatgaccagaaaccctgtatttgtgcttgcagacactcttgcagttgaggcattgcagaagatggtacaaggtaagttcagacatctgcctgttgtggagaatggtgaagtcattgcactgctggacattgccaagtgcctatatgatgctattgcacggatggaaagggcagcagagaaaggaaaagcaattgctgctgctgttgagggcgtagaaaagcattggggaacagctgcatctggtcctaaaaattttattgaaactcttcgagagaagatgtttaggccatcgctgtctaccattatctctgagaattcaaagtagagtggtcactgttgcaccaacagacacggtgttgacagcatcaaagaagatgctggaattaaaagtgagttcagccgttgtagcaattgaaaacaaacctgggggaattttgacctctagagatatattgatgcgtgttatcgcccaaaatcttcctcccgagtccaccacagttgagaaggtcatgacccagagtcctgaatgtgccacaattgacaccccaatccttgatgcccttcacacaatgcatgatgggaaattcttacatttgcctgttctagacagggatggcaatgttgtgactgttgttgatgttcttcacataacacatgctgcaattgcaacggtcgggaataccggagcagctggatctgaggcgacatctgccatgatgcagaggttctgggattcagcaatgtccattggacctctagatgatgacgacgactccagaagtgaaggatcaacaaaagtggcatctgaggcaacagatataggaagatctgcctttttttccagcttctggtttatcaagcactttcgggttcaagattcaggacaagcaaggcaggatgcacagatttaactgcgaaacgagcagcttgacagacctgataaccagcattcttcagagggtcggcgatgacattgatagaaaaaaccttcctcaaattttgtatgaagatgaggatcatgataaggtcatactttcatcagacagtgaccttatagctgctgttgatcatgcaagacagattggttggaagagtttgcggttgcacttggattatgttggcgttggccgccggaagagaggaggcggttcttcagattttgagtacgctggaaaggatgcatgggcctccgcgtacagtgctgtcgccgccggggcggctctagttgccggccttggggtaatggcttacctgaaacgagcgggttaagctttgaggcaagcacaacagggagcacattactgcattggaatgaccagaatggctgtgtaattaattcttgtgaggaaaaagaaagaaaaaaactgtaataatacttcacggcagtggatgaccgccttcatactacacggtgttggtcaaagttttggtggttggaagtctccatgattactatggctgtcagtgtcgcgcttgtatttgtatcataaatcacatgatcagtatacaaccgagaagcatgattatgccttcatttgtgctgtttccggaggattgtttgcctatgaagacgtgtttgatataaattttggt

SEQ ID NO: 1913 - DNA, 1577 bp, Brachypodium distachyon
agcgtaagcccagaccaaccaagctccatcctccaacagagttcttcacttcttcctctcttcccgagccagcagcagctagcttccccatcccggccccctcccctcaattgagtcaattcccccagaggagaaatggagaataatctaccagtcaatatccgtgagtaccaagaactggccaagaaagcactgccaaagatgcactttgattatatcaatgggggagcggaggatgagcacacgctgagggagaatattgcagcatatggaagaattgtgttacgacctcgatttcttgtagatgtcagcaacatagacatgtcaacaaacttattgggatatgacatgccctcacccataatggtcgcgccaacaggggcacacaaattagcaaatccagaaggggaagtggctacagcaagagcagccgcatcatgtaacagcgtaatggtgctctccttctcatccagttgcaaaatcgaggaggttgcctccagttgtaatgcgattcgcttttatcagttatatgtgttcaagaacagagatatttcagaaacattgatacggcgggccgagagttatggattcaaggcgattgttttgacagttgacacccctgtgctcggtcggcgtgaagctgatattagaaataagatgattgtcccatggaatgaaaacctcgaaggtttattgtcatttgatgatcttgatacaacagacggatctaagctcgagaaatattcacgcgagacgctggacccgtctttatcatggaaggacgtggagtggttgaaatccatatccagcctcccaattctactgaagggcatcgtcaccggcgaggacgcgaggagagcggttgaggccggtgtggcgggggtgatcgtgtccaaccacggcgctcggcagctcgactacgcgccggccaccatttccgccctcgaagaggtggtgaaggcggttgcgggggcggtgccggtgctggtggacggcggggtgcggcgaggcaccgacgtactcaaggcgctggcgctgggcgcgcgggcagtgatggtggggaggccagtgctgtacgggctggcggcgaggggcgaggccggggccaggcacgtgctcgagatgctgaactgggagctggaggtggccatggcgctctgcggctgccggagcatcgccgggatcacccgggaccgtgtccagaccgagggcgaccggatcaggtccctgctgtgaccaaccgaccgtgaggcgagcgcgacccaggcgtacgccgtgcagtgcaggagctacctattgcattgtcgacatgtataaattgagagtgacgttcataggagaaacgagatctagcgccagtagtggctaataaggatcttgtaaaaagggaaaggcggattgtgcctgtgccgtggcgtcaggaaaggacttgatacaacacatgttcggcttctcgcccggctttggttttttctaatgttcctaagatgtttcatctttcgatagatttgaaccgaagtatttacatctttttttcattgtactccgtaatatatatacccctttattatgttcaa

SEQ ID NO: 1914 - DNA, 1420 bp, Leymus cinereus x Leymus triticoides
  misc_feature (985)..(985): n is a, c, g, or t
  misc_feature (987)..(987): n is a, c, g, or t
cctcccgacatctccgatagctgcccatcctcccctagagtcgtcaatctctacagaaatggagaataatctaccagtcaatattcgcgagtatcaagaacttgccaagaaagcactgccgaagatgcactatgattatatcaatggaggagcggaggatgaacacacattgagggacaatattgcagcatatggaagaattttgttgcgacctcgggttcttgtagatgtcagcaacatagacatgtcgacaaacttattgggatatgacatgccctcgcccataattgttgcaccaacgggatcacacaaattggcaaatccagaaggagaggtggctacagcaagagctgcagcatcatgtaataccttaatggtgctatccttctcatccagttgcaaaatcgaggaggttggctccagttgtaatgcgattcgattttatcagttatatgtgtttaagaagagagatgtttcagcaacattggtacggcgggccgagagttgtggattcaaggcaattgttttgacagttgacactcctatgcttggtcgacgtgaagctgatatcagaaataaaatggttgctcctgcgaatgcgaacctcgaaggtttgatgccgatagatgatcttgatacagcagacggctcgaagcttgagaagtatgcgcgcgacacgctggacccgtctttatcatggaaggacgtggagtggctgaaatccataaccagcctgccgattctactcaagggcattgtgaccgccgaggacgccaggaaagcagtggaggccggggcggccggcatcatcgtgtccaaccacggcgcgcggcagctcgactacgcacccgccaccatatccgctctcgaagaggtagtaaaggcggtggcaggggcggtacccgtgctggtggacggcggagtccggcgggggaccgacgtgctcaaggcgctggcgctgggtgcgcgggcagtcatggtgggnangccggtgctgtacgggctggcggcgaggggcgaggcgggggcgaagcacgtgatcgagatgctcaacagggagctggagctggccatggcgctctgcggctgccggagcgtcaccgagatcacacgggaccgcgtccagaccgagggcgaccggttcaggtcgctgctctgatgagcgacgcgcgcggcagtcacagcacatactgtgaaggacatgcatgtgccagcgcccgcattgatcattcgagatgccggtagtgggattgatgctcatccgtgagaacaaacttgctgagaaggattttatttaaacacccagcatatataaggtggattttatccaaaaaatcgtacgaggttatttcttttgagagagttcttataaggtttgaatggacgcgcttgtatttatctgtttccaaaaacttcccac

SEQ ID NO: 1915 - DNA, 1497 bp, Zea mays
tgaagcattgctgtcaatttgactctaggtgcaaatatcaggctgcggccggcactggctttgtcctctaccttagtttctgacatcatcacatcgcaccgagggcgaggaggcaaaggaataacctgtgaagctgctgccatccactcatctttctgccttgattgcagtcattcctcccccaagtccatagagtgatagagaatggaggataatctaccagttaatgtccgggaatatcaagaacttgctaagaaagcactaccaaagatgcactatgattatatcaacggaggagcagaagatgaatatacactgagggagaatattgcagcatatggaagaattctgttacggccacgagtccttatagatgtgagcaagatagacatgtcaacaagcttattaggatataatatgccatcgccaataattgtcgcacctacaggggcacacaaattagccaatcccgaaggggaggtggccacagcaagagctgccgcagcatgtaacaccataatgatgctttccttctcatcaagctgcaggatcgaggaggttgcctccagttgcgacgctattcgcttttatcagttatatgtgtacaagagaagggatgtttcggcaacattggtacggcgggctgaaagtttaggattcagggcaattgttttgacagttgacacgcctgtgcttggcaggcgtgaagctgatatcagaaataagatgattgctccacctctgtcaaaccttgaaggtttaatgtcattagacgactttgacgatgctgaaggcggctccaagctggaacgattctcacgggagacgctggatccatcattgtcatggaaggacgtggagtggctcaagtccatcaccagcctgccgattctgctcaagggcatcgtcaccgcggaagacgcgaggaaggccgtggaggcgggggcggccggcttgatcgtgtccaaccacggcgcccggcagctggactatgcgccggccaccatctcggcgctcgaagaggtggttaaggcggtggcgggggctgtgccggtgctggtggacggcggcgtccggcgcggcaccgacgtgttgaaggcgctggcgctcggcgccaaggcagtcatggtgggcaggccggtgttctttgggctggcggcgcgcggggaagccggcgcgaggcacgtgatcgagatgttgaacaaggagctggagttggccatggcgctctgcggctgccgtagcgtcgcggaggtcaccagggcgcacgtccagaccgagggcgaccggatcagggccctgctgtgacttataaataagcgaccatatccgaggccgaccaccgtgctgtctgggttgcgatatgatttatatgatacgtgagggcatgtgatcgattgttgcctccacacagataagcttactattgccagagcctgggctggactatgctttcagtgattatctaaatcaaatagactgaatgctaaagggaac

SEQ ID NO: 1916 - DNA, 1278 bp, Sorghum bicolor
agatatatttgcaacataagagtgacctattcaacaatttaatgaagcagaatggaggataatctaccagttaatgtccgggaatatcaagaactcgccaagaaagcactaccaaagatgcactatgattatatcaacgggggagcagaggatgagtatacactgagggagaatattgcagcatatggaagaattctgttacggccacgagtccttatagatgtgagcaagatagacatgtcaacaagcttattaggatataatatgccatcaccaataattgtcgctcctacagggtcacacaaatttgcgaatccagaaggggaggtggccacagcaagagctgccgcagcatgtaacaccataatggtgctttccttctcgtcaaactgcagaatcgaggaggttgcctccagttgcgatgccattcgcttttatcagctatatgtgtacaagagaagggatgtttcggcaacattggtacggcgggctgagagtttaggattcagggcaattgttttgacagttgacacgcctgtgcttggcaggcgtgaagctgatataagaaataagatgattgctccacagttgtcaaaccttgaaggtttaatgtcattagacgactttgatggtggtgaaggcggctccaagctggaacgattctcacgggagacgctggatccatcattgtcatggaaggacgtggagtggctcaagtccatcaccagcctgccgatcctgctcaagggcatcgtcactgccgaagacgcgaggaaggccgtggaggtgggggtggccggcgtgatcgtgtccaaccatggcgcccggcagctggactatgcgccgcccaccatctcggcgctcgaagaggtggttaaggcggtggcgggggccgtgccggtgctggtggacggcggcgtccggcggggcaccgacgtgctcaaggcgctggcgctgggcgccaaggcagtcatggtggggaggccggtgttctacgggctggcggcgcgcggggaagccggcgcgaggcacgtgatcgagatgctgaacaaagagctggagctggccatggcgctctgcggctgccggagcgttgcggaggtcaccagggcgcacgtccagaccgagggcgacaggatcagggccctgctgtgatcgagtctctgagtgaggctgcgacccagcagcgaccatcgggacggacgaactgaatccatatataactaggggccttgtttactttcaaaaaaatttacaaaatatgaacagtattattta

SEQ ID NO: 1917 - DNA, 1529 bp, Saccharum officinarum
  misc_feature (865)..(865): n is a, c, g, or t
  misc_feature (1027)..(1027): n is a, c, g, or t
  misc_feature (1266)..(1266): n is a, c, g, or t
ctgctgcctttcactcatctttgtgccatccttggctgcagtcctccctcccccaagtccctagagcagaatggaggataatctgccagttaatgtccgggaatatcaagaactcgccaagaaagcactaccaaagatgcactatgattatatcaacgggggagcagaggatgagtatacactgagggagaatattgcagcatatggaagaattctgttacggccacgagtccttatagatgtgagcaagatagacatgtcaacaagcttattaggatataatatgccatcaccaataattgtcgctcctacagggtcacacaaattagcaaatccagaaggggaggtggccacagcaagagctgctgcagcatgtaacaccataatggtgctttccttctcatcaagttgcagaatcgaggaggttgcctctagttgcaacgccattcgcttttatcagttatatgtgtacaagagaagggatgtttcagcaacgttggtacggcgggctgagagtttaggattcaaggcaattgttttgacagttgacacgcctgtgcttggcaggcgtgaagctgacatcagaaacaagatggttgctccacggttgtcaaaccttgaaggtttaatgtcattagacgactttgatggtggtgaaggcggctccaagctggaacgattcgcacgggagacgctggatccatcattgtcatggaaggacgtggagtggctcaagtccatcaccagcctgccgatcctgctcaagggcatcgtcactgccgaagacgcgaggaaggccgtggaggcgggggcggccggcgtgatcgtgtccaaccacggcgcccggcagctggactatgcgccngccaccatctcagtgctcgaagaggtggttaaggcggtggcgggggccgtgccggtgctggtggacggcggcatccggcggggcaccgacgtgttgaaggcgctggcgctcggcgccaaggcagtcatggtggggaggccggtgttctacgggctggcggcncgcggggcggccggcgcgaggcacgtgatcgagatgctgaacaaagagctggagctggccatggcgctctgcggctgccggagcgtcgcggaggtcaccagggcgcacgtccagaccgagggcgaccggatcagggccctgctgtgaccccgccaccatccggacggacggacttcctgaattacataatacagtactactactactacattagtactacagactacagagtccgaccnttgtgctcgctgtcagtgttgcgatatgaatgtgagggtatgtgattgccattgattgctgcctccagaaataagctttgtgcgtcgccaatataagatccaactaactatttccagaacatgagctggattaagcttcagtgatttcctgcccaaagtgctcaacgtatgttgggacttgggagccctgtcccgaatactgaatacatgagaacggccccgttcggctgtgctgataatgcgactgaaaacattgtttgact

SEQ ID NO: 1918 - DNA, 1502 bp, Panicum virgatum
ggactgctcatagaagcagctgcctctcactcatagccacatcctctacctcgacggcggtccttcctcctgacctcctcctccaagtccctagaggctagagcaaaaatggaggataatctaccagtcaatgtccgggagtatcaagaactcgccaagaaagcactaccaaagatgcactatgattatatcaatgggggagcggaggatgagtacacactgagggagaatattgcagcatatggaagaattctgttacggccaagggttcttatagatgtcagcaagatagacatgtctacaactttgttaggatataatatgccatcgccaataattgtcgctccaacaggagcacacaaattagcaaatccagagggggaggtggccacagcgcgagcagcagcagcgtgtaagaccgtaatggttctttccttttcatccagctgcaaaatcgaggaggtcgcctccagttgcgacgccattcgcttttatcaattatatgtgtacaagagaagggatgtttcagcaacattggtgcgacgggctgaaagtttaggatttaaggcaattgttctgacagttgacacgcctgtgcttggtaggcgtgaagctgatatcagaaacaagatggttgctccacggatgccaaaccttgaaggcctgatgtcattcgatgatgatcttgacagtgaaggcggctccaagctggaaagattcgcgcatgagacgctggatccatccttgtcatggaaggacgtggagtggctcaagtccataaccagcctgccgatcctgctcaagggcatcgtcaccgccgaggacgccaggaaggccgtggaggttggggcggccggcgtgatcgtgtccaaccacggcgcccggcagctggactacgcgccgcccaccatctccgcgctcgaagaggtcgttaaggcggtggcgggggccgtgccggtgctggtggacggcggggtccggcggggcaccgacgtgttcaaggcgctggcgctgggcgccacggcagtcatggtggggaggccggtgttctacgggctggcggcgcgcggggaggccggggcaaggcacgtgatcgagatgctcaaccgggagctggagctggccatggcgctctgcggctgccggagcgtcgccgaggtcaccaggcggcacgtcctgacggagggcgaccggatcagggccctgctgtgagcctgcctttgacccatccagtcagggacggttgcgatgtgagcgcatgcatgtgacattgattgatcgctccaaaaatttaagccattgtgcattgaaggttggcagaatctgtgctggatcaagctctctgttctgcttctgtgagaacttggtcattgtatcttgggatccacctctggaataacatgagaacatcgtgaggcaaataagcaactttcaaacaccaaattctgatgacaagtaactccattcagctcatcggtcgtgagagcagctaggcgggcttc

SEQ ID NO: 1919 - DNA, 1435 bp, Panicum virgatum
tcgatagcggtccttcctcccggcctcctccaaccaagaccctagagcaaaaatggaggataatctaccagtcaatgtccgggagtatcaagaactcgccaagaaagcactaccgaagatgcactatgattatatcaatgggggagcggaggatgagtacacactgagggagaatattgcagcatatggaagaattctgttacgtccgagggttcttatagatgtcagcaagatagacatgtctacaaccttgttaggatataatatgccatcgccaataattgtcgctccaacaggagcacacaaattagcaaatccagaaggggaggtggccacagcgagagcagcagcagcatgtaacaccataatggttctttcctttggatccagctgcaaaatcgaggaggtcgcctccagttgtgacgccattcgcttttatcaattatatgtgtacaggagaagggatgtttcagcaacattggtgcgacgggctgaaagtttaggatttaaggcaattgttctgacagttgacacgcctgtgctcggtaggcgtgaagccgatatcagaaacaagatggttgctccacgaatggcaaaccttgaaggcctgatgtcattcgatgatgatattgacagtaaaggcggctccaagctggaaagattcgcgcatgagacgctggatccatccttgtcatggaaggacgtggagtggctcaagtccataaccagcctgccgatcctgctcaagggcatcgtcaccgccgaggacgccaggaaggccgtggaggttggggcggccggcgtgatcgtgtccaaccacggcgctcggcagctggactacgcgccgcccaccatctccgcgctcgaagaggtggttaaggcggtggcgggggccgtgccggtgctggtggacggcggggtccggcggggcaccgacgtgttcaaggcgctggcgctgggcgccacggcagtcatggtggggaggccggtgttctacgggctggcggcgcgcggggaggccggggcgaggcacgtcatcgagatgctgaaccgggagctggagctggccatggcgctctgcggctgccggagcgtcgccgaggtcaccaggcggcacgtcctgacggagggcgaccggatcagggccctgctgtgagcctgcctttgactttagataagatacatggagactgcccgcccgtctacctatctagtgtcagggttgcgatgtgaatgtgagcgcacgcatgtgacattgattgatcgctccaaaagttaagccattgtgcatttccaatacccaaacgaaggttagcagaatctgtgctggattaagctctctgttctgtgagaacttggtcattgtatcttgggatccacttctggaataacatgagaacatggtgaggtaaataagcaactttcaagcaccaaa

SEQ ID NO: 1920 - DNA, 598 bp, Hordeum vulgare
cggcacgagggtagtattacacacaaagtaggagacatccaaagctagtcggagagaggagaggagctcggcaggccggcggcgagatgtataccaaccctccgtcggggcaggagatgtcctacaccgaccacgtgcagaggcgccacgaggagaagggctgcctctacgcatgcgtgttcacggcgctgtgctgcttctgctgctacgagacctgcgagtgctgcctcgactgcctctgctgctgctgcaactaaaccagccatggccgccatggacggaggccgcaaggcgcagcggagacccccaccagcctcagccgcctttcataataagcatatatgtgtgtctagtgtctcagctcgatcagaagaactgtatcagatatttctgtactgcctttcacaataagcatatatatggtttctagtcttattttacgccggttgtggctttcttttactttcaattgtttactttacagccttttcataggctatttctggactagacattttccgttattttaaataaatgtggccgtatgcatctttctgatgcagaggctagagatgagtttccttttaaaaaaaaaaaa

SEQ ID NO: 1921 - DNA, 632 bp, Hordeum vulgare
cacgcgtccgtcttcccaaagccacaggaaaggagagcggagcagagcacaacccttggaggctgcttcttcttcttcttcttcttcttccatatatagtaacccaccctaccctttgccaagatgtacgacgctccgtcggggcaggagatgtcctacaccgaccacgtgcagaggcgccacgaggagaagggctgcctctacgcatgcgtgttcacggcgttgtgctgcttctgctgctacgagacctgcgagtgctgcctcgactgcctctgctgctgctgcaactaaaccagccatggccgccatggacggaggccgcaaggcgcagcagagacccccaccggcctcagccgcctttcataataagcatatatgtgtgtctagtgtctcagctcgatcagaagaactgtatcagatatttctgtactgcctttcacaataagcatatatatggtttctagtcttattttacgtcggttgtggctttcttttactttcaattgtttactttacagccttttcataggctatttctggactagacatttcccgttattttaaataaatgtggccgtatgcatctttctgatgcagaggctggagatgagtttccttttctaaaaaaaaaa

SEQ ID NO: 1922 - DNA, 507 bp, Hordeum vulgare
gaggagagcagagcagagcacaacccttggagacttcttccacacagtaacacaccctaccctttgccaagatgtataacgctccgtcggggcaggagatgtcctacaccgaccacgtgcagaggcgccacgaggagaagggctgcatctacgcatgcgtgttcacggcgctgtgctgcttctgctgctacgagacctgtgagtgttgcctcgactgcatctgttgctgctgcaactaaaccagccatggccgtcatggacggaggccgcaaggtaaaggggagacccaccggcctccgccgcctttcacaataaacatatatatgtgtctagtgtcttagctcgatgagaggaactgtatcggattttgctactataataccatctgtctcggacaagactatcactgtaatcttcgatcatggttcgtgttgcatcttaatttaatttagcatcagattctggctaagccaaaaaaaatagttacaagataggacccccttacgc

SEQ ID NO: 1923 - DNA, 922 bp, Hordeum vulgare
aagccacaggaaaggagagcggaacagagcacaacccttggaggcttcttcttcttcttcttcttccatagtaacccaccctaccctttgccaagatgtacgacgctccgtcggggcaggagatgtcctacaccgaccacgtgcagaggcgccacgaggagaagggctgcctctacgcatgcgtgttcacggcgctgtgctgcttctgctgctacgagacctgcgagtgctgcctcgactgcctctgctgctgctgcaactaaaccagccatggccgccatggacggaggccgcaaggcgcagcgaagacccccaccggcctcagccgcctttcataataagcatatatatgtgtctagtgtttcagctcgatcagaagaactgtatcagatatttttgtactgcctttcacaataagcatatatatggtttctagtcttattttacgccggttgtggctttcttttactttcaattgtttactttacagccttttcataggctatttctggactagacatttcccgttattttaaataaatgtggccgtatgcatctttctgatgcagaggctggagatgaagttccttttctaaaaaaaaaaaaaaaaaaaaaaaactgatcaaatttgctgtacattattgtcccgaaaaaaaaaaaaaaaaaactcaggggggcgcggcccaattcccttgggaggcgataaattcacggccgcgtttacaaggcggacggaaacccggcgtaccactatccctggaaaatccccttccagtggtaaacaaaagccgaccgtcccttcaacgtgccccgatggaagggatgagctatttgtaaacgctaattgtaaaccttttacaggcaggaaccttataaatacgaggtggtgtctggaaagcttaaagccccaggaccttggggc

SEQ ID NO: 1924 - DNA, 610 bp, Hordeum vulgare
ccaaagccacaggaaaggagagcggagcagagcacaacccttggaggcttcttcttcttcttcttcttcttccatagtaacccaccctaccctttgccaagatgtacgacgctccgtcggggcaggagatgtcctacaccgaccacgtccagaggcgccacgaggagaaaggctgcctctacgcatgcgtgttcacggcgctgtgctgcttctgctgctacgagacatgtgagtgctgcctcgactgcctctgctgctgctgcaactaaaccagccatggccgccatggacggaggccgcaaggcgcagcggagacccccaccggcctcagccgcctttcgtaataagcatatatgtgtgtctagtgtctcagctcgatcagaagaactgtatcagatatttctgtactgcctttcacaataagcatatatatggtttctagtcttattttacgccggttgtggctttcttttactttcaattgtttactttacagccttttcataggctatttctagactagacatttcccgttattttaaataaatgtggccgtatgcatctttctgatgcagaggctggagatgagtttccttttctaaaaaaaaaa

SEQ ID NO: 1925 - DNA, 577 bp, Brachypodium distachyon
aaaggctaccacgcaacactgcagccttctcggcctacaaaacgccatccactcttcctccttcctgttccaatcctcctccttgagctgagtgcttccactcagcattagccagtagctaagccttctgacttctacagccgtcggaagatcgaagatgtacaacgctccgatggcgcaggagatgtcctacttggatcatatgcaaaggcgccacgaggagaagggctgcctctacgcatgcttattcacggcgctgtgctgcttctgctgctacgagacctgcgagtgctgcctcgaatgcctctgctgctgctgcgactaagctagctatcacccggcggcgtcaaactctccggcaggagatcaaccgtccgtcgccttcatttagccccaaattcataataagcatcgtttgtactgtaagcttaatcaattaattagctcgatgtcgggtatactatatactaatattttctgtgccgaaagacattattactgtaatcatcatcatggtttgagtggctttgttgcaatattttaattaatcgatcagttagcatcatattctgtctct

SEQ ID NO: 1926 - DNA, 595 bp, Theobroma cacao
cggggaccaccactcattccaccaacaccaagggatcgagaagaagaagatcaggagagagagagacgaaacccttgctcattcatcagttcatcaccaccacagctccgcaaggcagcaggcagcaggcgaagatgtacaacgcgccgtccgcccaggagatgtcctacttcgagcacgtgcagaggcgccacgaggagaagggctgcctctacgcctgcatcttcacggcgctgtgctgcttctgctgctacgagacctgcgagtgctgcctcgactgcctctgctgctcctgcaactagaggctctggctccggctcctgaggacgagccagatgcagatggagatcgcctccgtctcttctatctacctaatgatgatgatgatgattcagtttcagtttcagtttcagtagcctgcttcctttagtctggtcgtgcaagtgcaaacataataaagcatgtcgtagtacaagggagatttactctgtcagtttgagcattcgtaaaccaaccatggtttgaaccaccgcatcttttgttattgttattgttatcacccgattccgattctgaacacaacgcattctcgcgc

SEQ ID NO: 1927 - DNA, 510 bp, Festuca arundinacea
  misc_feature (16)..(16): n is a, c, g, or t
ggcacgaggggagagntctggcatagtagccttcttctccagccagccagacagccagttaggactagccagggaagatgtataacgctccgtcggcgcaggagatgtcctactccgaccatgtgcagaggcgccacgaggagaagggctgcctctacgcatgcgtgttcacggcgctgtgctgcttctgctgctacgagacctgcgagtgctgcctcgactgcctttgctgctgctgcaactagctccactctgctcaactccggcaggaagaagatggagatccaccggcctccttccgtcgccttcaattacccttaataaacatgttaaggttcttaataatcgtgtgtgtctagtctagtatagcttacctttatgaagaatttctcagatattttgtggtacttctgtcccagacaagattactgtaatcatcgatcgtgtcgcctgttgcagctgctgccatagcattttaattttaataatcatcagattctggttcggatc

SEQ ID NO: 1928 - DNA, 523 bp, Festuca arundinacea
ggcacgagggagagttcttgcatagttagccttcttctccagccagccagacagccggttaggacttgcaagctaagccaggcaagatgtataacgctccgtcggcgcaggagatgtcctactccgatcacgtgcagcggcgccacgaggagaagggatgcctctacgcatgcgtgttcacggcgctgtgctgcttctgctgctacgagacctgcgagtgctgcctggactgcctctgctgctgctgcaactagccactgtcgagctccggccggcaggaacaagatggagatggagatccaccggcctccctccgtcgccttcaattacccctcgacatgttaagattcttattaataatcgtgtgtgcctagtctagtagcttacctctatgaaaaaattgtcagatattttacggtatttctgtcccggacaagattactgtaaccatcgatcatgtcgcctgttgtagctgcagctatagcattttaatttaaattaccatcagattctggttcggatc

SEQ ID NO: 1929 - DNA, 712 bp, Leymus cinereus x Leymus triticoides
  misc_feature (7)..(7): n is a, c, g, or t
  misc_feature (10)..(10): n is a, c, g, or t
  misc_feature (64)..(66): n is a, c, g, or t
gagcacngtngagagaaacccttgcaagtcccttcgagagttcttcttccatagtaacccaacnnntttgcaaagccagctaaaaagatgtataacgctccgtcggggcaggagatgtcctacacggaccacgtgcagaagcgccacgaggagaaaggcttcatctacgcatgcgtgttcacggcgctttgctgcttctgctgctacgagacctgtgagtgctgcctcgactgcctctgctgctgctgcaactaaaccagccatggccgccatggacggacggatggagaaaggggtgcggagatccaccagcctccgccgactttgattacccagacatttttggaatttcataagcatgtgtgtctagtgtcttcgctcgataagaactatatcagatattgctataatattatccataccggcaaggcgattactgtaatcatcgatcatggtttgtgttgcattttaatttaattagcatcagattctagttctcaccagaccactgtgacgtttctttttattttatttctctttattactccctgaaataatttgaagactgaaatgaatatgcgcagctactaatgactctctactgtggcgacgggaggggaaaaccctagccgccgccaaccgccgccctccccacctctcccccctcctcccccgccgccccaaggcgcggccgggcaaagcctggccgtcg

SEQ ID NO: 1930 - DNA, 485 bp, Lolium multiflorum
ttcttctccagccagccagacagccggttaggactagccagggaagatgtataacgctccgtcggcgcaggagatgtcctactccgaccacgtgcagaggcgccacgaggagaagggctgcctctacgcatgcgtgttcacggcgctgtgctgcttctgctgctacgagacctgcgagtgctgcctcgagtgcctctgctgctgctgcaactagcccactctgctcaactccggcaggaacaagatggagatccacgggcctccttccgtcgccttcaattacccctcaacatgttaagattctgaattaataatcgcgtgtgccttgtctagtagctcacctctatgaagaatttgtcagatactttaccttacttctgtcccggacaatattactgtaaccatcgatcatgtggcttgttgcagctgctgccatagcattttataatattaattgcatcgcattctggttattaaaaaaaaaa

SEQ ID NO: 1931 - DNA, 517 bp, Eragrostis curvula
  misc_feature (84)..(84): n is a, c, g, or t
  misc_feature (93)..(93): n is a, c, g, or t
  misc_feature (109)..(109): n is a, c, g, or t
  misc_feature (143)..(143): n is a, c, g, or t
  misc_feature (200)..(200): n is a, c, g, or t
  misc_feature (338)..(338): n is a, c, g, or t
  misc_feature (457)..(457): n is a, c, g, or t
  misc_feature (516)..(517): n is a, c, g, or t
tcgaaagcaagaaaggagaggagaagaacaaaaaagacaacggactatgcgaggaaggaacaggagagacgaagcccctgttantcctctacncttcatcacacccagncagccagatagaacttgattacaagcaaggttgncaagatgtataacgctccaacggcgcaggagatgtcctacttcgatcatgtgcagangcgccatgaggagaagggctgcctctacgcatgcatcttcaccgcgctgtgctgcttctgctgctacgagacctgcgagtgctgcctcgactgcctctgctgctgctgcaactaggtgtcgagcaccaacagagaagnagatgaagatggaggtcggactccatcgcttacccgagattcagtagcctgtttacttttatttggttgtgcagaaataattaaagcatgtagtgggggaagaaagctttgtcagatcnagcaattgtgttctgaacaatatcattatcgtattgtaactatggtatgaactgatggnn

SEQ ID NO: 1932 - DNA, 871 bp, Zea mays
tagaaataacaaagcatggttgattaatggaagaaattagcacaaaatatcgctttcatggtcaagttttccttatcccgcaggggcagggcactgggaaggtgcctggaagcagccctcatatgctagctggagctgaaaccctatctataaagaaggctgaaggctccacacatacaactccgtagagctccctgctttgttcagacttcagagcccttcctcttgtgtccgtgcaaattggagatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttttgtgtgtgtgcgcgcgcatcttcatttgcactggaaaatgctttataatttgtgaaggcctgtaaatctgttgtatgtatcttggtcagatgaactctattattgtgccatatatctcgcttgattggacaaatcctttcgaagtttcctcttgtccttgcttatcgatggcagggttagaaggagagagttcgaaaaacaaaagtatttgtgactgtttatttttcggatgcgtgaaagctgcagtaactttatgttggaatgcaattcctgctgtcaccagccatacgc

SEQ ID NO: 1933 - DNA, 599 bp, Zea mays
ataaagaaggctgaaggctccacacagacaactccgtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttgtgtgtgtgtgaaatgcattagtgtctgtttgatgtgatcttgtgtgtgtgcgcgcgcatcttcatttgcaccggaaaaatgctttgtgaaggtctgtaaatctgttgtatgtatcttggtcagatgaactctattattgtgccatatatctcgcttgcattggacaaa

SEQ ID NO: 1934 - DNA, 576 bp, Zea mays
agcagtccaccactcgttcgttccaaacggagaagaggatcaggttcgttccaagggaagggagaagagggtcaggagagagagagagagagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcactgcgctgtgctgcttctgctgctacgagacctgcgagtgctgcctcgactgcctctgctgctgctgcaactagccggggctagctccggaggacggtcgagacgcagcagatggaggtcgcctccgtctcttctacctacctaccaatctacctagtgatgatgattcagttcccgtttagtctggtggtgtgcaagtgcaaacataataacgcacgcatgtcgtagcgtagtacaggagagatgttttactctgtcagttccagtttgagcattcgtaaaccaaccaaccatggtctgaactctgaaccaccgc

SEQ ID NO: 1935 - DNA, 542 bp, Pennisetum glaucum
gggaacagaccctccatactgctccctgctttgttcaaagcccctttccctttactccttgcatactggaaatacttgaacagcgagctccatatagaaaacaagatgtacaaccctccgagttctcaggacatgtcctactacgatcatgttcagaagcgccatgaggagaagggctgcctatatgcatgcctgttcactgcatgctgctgcttctgttgctacgagacctgcgagtgctgcatcgaggccatctgctgctgctgctaatccagctcaaggacatccatcatggacaggtggccgagcgggacattcagcgctgtcccgtatatatatggaccatggctatcaataaatcctgtacttgtgcaagtatgttaaaatgttttactgtctgtatgatgtaatgttggtgtctctgcatgtttgtattgaaaatgtgctgtaaaaatgctgtaaatctgttatattttggtaagacgaatgaattattgcattgtgatcccgctatatcaaaatgaaatcaccgcacttatact

SEQ ID NO: 1936 - DNA, 569 bp, Pennisetum glaucum
ggggtctataaatcccatccaccactcctttccaagagataaacaagatcaggtgagacgagagaccctcgcccttcgtcgtctccacttgttcatcaccagccggccagccaagatgtacgacgccccaaccgcgcaggagatgtcctactacgaccatgtgcagaggcgccacgaggagaagggctgcctctacgcatgcgtcttcacggcgctgtgctgcttctgctgctacgagacctgcgagtgctgcctcgactgcctctgctgctgctgcaactagggccgccgtggcgccgtcgtctgcctgcagctccacaaggccagacgggatgaagattcagtagcctgcctgcttgctttgcttgcttttagtcttcttgtgatttgtgaacagcataataaaccatgtcgtggtaaatttgtcactctgtcagtatgcatgattgcgtgagcattcgcatgccctgaacaaaggattctactagctctgtaaccatggtttgaacctctgccatcgtattgttagcatctcattagttcggtaaactatggtttgaaccgctgac

SEQ ID NO: 1937 - DNA, 520 bp, Avena sativa
cggcacgagggaagaggagagttcctgctgcatagtaagccttcttctccagccagacagagagtcggttaaggcaggcaggcaagatgtacaacgctccgtcgtcgcaggagatgtcctactccgaccacgtgcagcgccgccacgaggagaagggatgcctctacgcatgcgtgttcacggcgctgtgctgcttctgctgctacgagacatgcgagtgctgcctcgactgcctctgctgctgctgcaactagcttactccggctgtccggcaggaggaacaagatggggatggagatccaccggcctcctcctccgtcgccttcaatcaattacccgctactacaattcaagattcagctttactgtgtgcctagctgtttttctttactgttgtagtagtacatgattattactgaaatcctcaatcatagtttgtttacccgcaaaaagaaaaagaaaaacaatcatagtttggtgccgttcctgctacccaagcaatttaattttgattagcacg

SEQ ID NO: 1938 - DNA, 373 bp, Ananas comosus
cagtagagatcgaagaagatgtataacccaccgagcgcgcaggagatgtcctacttcgagcacgtgcagaagcgccacgaggagaagggttgcctctacgcttgtttatttgtactgtgttgctgcttctgctgctacgagacctgcgaatgttgcctcgattgcctctgctgctgctgctaaatatgtcgttcgattaaaaaagtagattcttcttagcgagaataaaatatgtaattaactactttggatgtattgcgctgttatgttcttcgttttatatatatggtaatgcttatgaactctgctcgagttcatgagtttcatgtttgaacctataatttgtttgattgtggtgacagtggtagtattc

SEQ ID NO: 1939 - DNA, 492 bp, Oryza sativa
tcctgcaagcaacaagagaggacaggagaagaaaaccttggcccttgaatagttgtgttcttctctgaaacctttttagagaggtgagtgcttgttcatcagaagcagagagacaagatgtataacgctccaatggcacaggacatgtcctactatgaacatgtgcagaggcgccatgaggagaagggttgcctctatgcatgcatcttcactgcactgtgctgcttctgctgctacgagacctgcgagtgctgcctcgactgcctctgctgctgctgcaactaggctgccatatcaagccatagcaagaacatgatcaagatgaggatggagatcgcctccatctctcttacccctgagatttcataatttatcagcccgttgtcatcatgtaaaattaataaacatgtagtagatggaaactttgtcagaatcgagcatttgtgttctgaaaaagaggactattgtaagaaacccagaatactgttatct

SEQ ID NO: 1940 - DNA, 662 bp, Sorghum bicolor
atggtcaagttttccttaccccgcagggcactgggatggtgcctggaaaaagggtcatatgctagctggagctgaaaaccctataaagaaggctgaaggctccacacagacaactaacagaccctctgtgcagctccctgctttctttagatccctttctcttctgtccttgcaaattggagatacttgaacggcgatctccatatagtgagcaagatgtataatcctcccagtgcgcaggacatgtcctactacggtcatgttcagaagcgccatgaggagaagggctgcctatatgcatgcctgttcacagcgtgctgctgcttctgctgctacgagacctgtgagtgctgcctcgaggccatctgctgctgctgctagttcagcttagacggcatgcatgggcatccatcatcgtggagatgctgcctcaatgctagctgtcccgtacacaaataaaatgctgtacttatatgcacgtacactaaaaatgcattagtgtctggatgtgtaatcgtgttgtgtgtgcatctttatttgcatttgagaatgctttgtgaaatgctgtaaatctgttgtatgcatattggtcagatgaatttagtgtgacgcatgtgtatcaaactgaaattactgcactattgagatgatgaagatttacc

SEQ ID NO: 1941 - DNA, 1005 bp, Sorghum bicolor
agcaataattgtacaagacgttgctggcaggtgggaccacggagtcctactatcaaagacgcgaccatcccttcgtccgtgcgccttgtggcgccggtgtgaagagcgacggctagccgccggtacacgtacaccatttccctcttcttccccgtctataaattctacccacaactagccatagcaagccagcagcccaccactcatttcaccaaaccaagctaagggagaagaagaagatcaagagagacgaaaaccttgctcattcatcagctaggttacttcaccaccacagctttggctcgcaaccgcaaggcagcaggcagcaggcgaagaagatgtacaacgcgccgtcagcccaggagatgtcctatttcgagcacgtgcagaggcgccacgaggagaagggctgcctctacgcctgcatcttcacggcgctgtgctgcttctgctgctacgagacctgcgagtgctgcctcgactgcctctgctgctgctgcaactagcctgacatccggctccagaggaggatcgacatgcagatcgatggagatcgcctccgtctctcttctacctacctagtgatgattcagtagcctgctttcctttagtcgcctggttgtgcagacataataataaagcatgcatgtcgtagcgaaagagagatttactactctgtcagtttgagcattcgtaaaccaaccatggtttgaaccaccgcatcttttgttactgttgttgttatcagttcatccaattccgattctcaacacaacgcattcgcttcgcgcaatttatctgtaactgtactgctgctatgcgttctgatccgatggaatttattcttcatgttctctttttatatatatgtgcaaaaaaggtgcagtaatcatggcagaattcaggttctggggaaccctgttcgactggggccgatcttttcatgtctgaaaaactatctatcaccagcagcagcgtctgggctgctgcaccagatcttgccta

SEQ ID NO: 1942 - DNA, 582 bp, Saccharum officinarum
  misc_feature (61)..(61): n is a, c, g, or t
  misc_feature (315)..(315): n is a, c, g, or t
actcattccaccaacaccaagggatcgagaagaagatcaggagagagagacgaaacccttnctcattcatcagttcaccaccaccacagctccgcaaggcagcaggcagcaggcgaagatgtacaacgcgccgtccgcccaggagatgtcctacttcgagcacgtgcagaggcgccacgaggagaagggctgcctctacgcctgcatcttcacggcgctgtgctgcttctgctgctacgagacctgcgagtgctgcctcgactgcctctgctgctgctgcaactagaggctctggctccggctcctgaggacganccagatgcagatggagatcgcctccgtctcttctatctacctaatgatgatgatgatgattcagtttcagtttcagtagcctgcttcctttagtctggtcgtgcaagtgcaaacataataaagcatgtcgtagtacaagggagatttactctgtcagtttgagcattcgtaaaccaaccatggtttgaaccaccgcatcttttgttattgggtatgggtattgtatcacccgctttcgattctgaacacaacgcattcggtcgcgca

SEQ ID NO: 1943 - DNA, 552 bp, Saccharum officinarum
  misc_feature (80)..(80): n is a, c, g, or t
  misc_feature (276)..(277): n is a, c, g, or t
gcagctccctgctttgttcagagccctttctcttctgtccttgcaaattggagatacttgaacagagatctccatatagngagcaagatgtataatcctcccagtgcccaggacatgtcctactacgatcatgttcagaagcgccatgaggagaagggctgcctatatgcatgcctgttcactgcgtgctgctgcttctgctgctacgagacctgtgagtgctgcctcgaggccatctgctgctgctgctagttcagcttagacggcatgcatggnnatccatcatcgtggagatgtggccaagcgggacactcacagctgtctgtccccatacatagactatggtcatcaaataaaatgctgtacttatatgcacgtacattaaaattgcattagtgtctgtttgatgtaatcttgtgtgtgcatctttatttgcatttgaaaatgctttgtgaaatgctgtaaatctgttgtatcttggtcagatgaatgcattattgtgatgctggtgtaaaaaactgaaattaccgctttcttaagtctggatgatgc

SEQ ID NO: 1944 - DNA, 503 bp, Saccharum officinarum
ctcattccaccaacaccaagggatcgagaagaagatcaggagagagagacgaaacccttgctcgttcatcagttcaccaccaccacagctccgcaaggcagtaggcagcaggcgaagatgtacaacgcgccgtccgcccaggagatgtcctacttcgagcacgtgcagaggcgccacgaggagaagggctgcctctacgcctgcatcttcacggcgctgtgctgcttctgctgctacgagacctgcgagtgctgcctcgactgcctctgctgctgctgcaactagaggctctggctccggctcctgaggacgatccagatgcagatggagatcgcctccgtctcttctacctacctagtgatgatgatgatgattcagtttcagtttcagtagcctgcttcctttagtctggtcgtgcaagtgcaaacacaataaagcatgtcgtagaacaagagagattactctgtcagtttgagcattcgtaacaaccatggtttgaacca

SEQ ID NO: 1945 - DNA, 732 bp, Panicum virgatum
ggaaggtgcctggaacggccgacatgttgcaagttggccagctgaatgccctataaagaaggcttcatatccacacatatgattaacacaccctctatacagctccctgctttgttcagagcccctttcctttactccttgcatattttagatacttgggcagtgagctccgtcaggcaaacaagatgtataaccctcccagtacacaggagatgtcctactacgatcatgttcagaagcgccatgaggagaaaggctgcctatatgcatgcctgttcactttgtgctgctgcttctgctgctacgagacctgcgagtgctgcatcgagaccatctgctgctgctgctagtccagctcgagggcacagggcacacccatcacggagatgtggccaagcgggacactcagcgctgtcccaacatgggccatggaccatggttatcaataaaatgctgtgcttatgcaagtatgttgaaaacgtattaatgcctgtttgatgtcatgttcgtgtgtcggtgtgcgtgcatatttgcactgaaaatgttttgtaaattctgtaaatctgctgtatcttgttcagatgaatgcattgttgtgattctgctgtatcaaactgaaattaccgcacttctgagtcagtaggatacagatttacctattttctggggaccttgctgaggatgcaagttaagaagaagagggttggaatataaaaggcataattaccattt

SEQ ID NO: 1946 - DNA, 581 bp, Panicum virgatum
ataaatgctgtcctctccaccactccttccttccaagttccaagagaggagaagatcaggatagaatcgaaggaacccttgcccagttgctgcccctcccctctcctttgtccatcagctgactagctgagtagttcaccaccaccaagtcaggcaagatgtacaacgctccatccgcgcaggagatgtcctacttcgaccatgtgcagaggcgccatgaggagaagggctgcctctacgcatgcatcttcacggcgctgtgctgcttctgctgctacgagacctgcgagtgctgcctcgactgcctctgctgctgctgcaactaggccgccgcctgctgcttcagaaggcctgatggagatggagatggcctctgtctttcttacctcaaaatcaagtagcctgcttggctgcttgctttagtctggttgtgaagagcataataaagcatgttgccctgtagttattctgtcagtatgaacatttgtgtgttctgaacagggttctgttagtactgtaaccaatggtttgaactgccgcatcatattgtcagtatccgattccgattctgaacccactgc

SEQ ID NO: 1947 - DNA, 604 bp, Panicum virgatum
caagagagcagaagagaacaggatagaatcgaaagaacccttgcccagttgctgcccctcccctaccctttgtcatcagctgagtagttcaccaccaccaagtcaggcaagatgtacaacgctccatcggcgcaggagatgtcctacttcgaccatgtgcagaggcgccacgaggagaagggctgcctctacgcatgcatcttcacggctctgtgctgcttctgctgctacgagacctgcgagtgctgcctcgactgcctctgctgctgctgcaactaggccgccgcctgcagctccagaaggccggatggagttggagatggcctgtgtctttcttacctgaaaatcaagtagcctgcttggctgcttgctttagtctggttgtgaagaacataataaagcacgttgtagttattctgtcagtatgagcatttgtgtgttctgaacaaggttctgttagtactgtaaccaatcgtttgaactgccgcatcatattgttagtatccgattccgattctgaacccactgcatttctctcgcgttaatttatctgtactgctgctacgcgttctaatggaattttaatcttcttcttcatttgttt

SEQ ID NO: 1948 - DNA, 506 bp, Panicum virgatum
cagctctctgctttgttcagagcccctttcctttactccttgcatattgtagatacttggacagtgagctccgtcaggcaaacacgatgtataaccctcccagtgcacaggagatgtcctactacgatcatgttcagaagcgccatgaggagaagggctgcctatatgcatgcctgttcactttgtgctgctgcttctgctgctacgagacttgcgagtgctgcctcgagaccatctgctgctgctgctagtccagctcgaggagacacatcatggaggtgtggccaaacgggacactcagcgctgtcccacacacacatgggccatgtaccattgttatcaataaaatgttgtgcttatgcaagtatgttgaaaacgtattaatgcctgtgtgatgtcatgttcgtgtgtcgggtgtgcgtgcatatttgcactgttttgtaaaattctttaaatttgctgtatcttgctcagatgaatgcattttattgtgatcctgctgtatc

SEQ ID NO: 1949 - DNA, 532 bp, Triticum aestivum
  misc_feature (44)..(44): n is a, c, g, or t
caatcctacatcttcccaaagccggtcacaggagagcagagcanaatccttggagagtatcttcttcttccatagtaacccactccaccctttgccaagatgtacaacgctccgtcggggcaggagatgtcctacacggaccacgtgcagaagcgccacgaggagaagggctgcatctatgcatgcgtgttcacggcgttgtgctgcttctgctgctacgagacctgcgagtgctgcctcgactgcctctgctgctgctgcaactaaaacagccatggccgccatggacggacggaggctgcaaggcggagcggatatccaccggcctccgccgcctttcataataagcatatgtgtctagtgccttagctcgatgagaactgtatcagatgttgctgtattattattgtccaggacaagactatcattgtaatcaccgattatggtttgtgttgcatcttttttttttccgggggtttgtgttgcatcttaatttaattagcatcagattcgtgttccctgaaaaaaaaaa

SEQ ID NO: 1950 - DNA, 542 bp, Triticum aestivum
caggagaggagagcagagcagagcacaacccttggacacctcttcttcttcttccatagtaacccaacccaccctttgcgaagatgtataacgctccgtcggggcaggagatgtcctacacggagcacgtgcagaagcgccacgaggagaagggctgcatctacgcatgcgtgttcacagcgctgtgctgcttctgctgctacgagacatgcgagtgctgcctcgactgcctctgctgctgctgcaactaaaccggacatggccgccatggacggaggccgcaaggcgcagaggagatccaccggcctccgccgcctttcataataagcatatgtgtctagtgtcttagctcgatgagaactgtatcacaactttgctataatactatctgtccttgtaatcatccatcatggtttgtgttgttgctgctgctctaccattttaatttaattagcatcagattatggttctcaccaaatcaccggccgcgtctttttcctatttgttttcctttcgtccctgaaattatctaaagactgaaa

SEQ ID NO: 1951 - DNA, 479 bp, Triticum aestivum
gagcaggcagagcagaatccttggaggcagttcttcctccatagtaacctaacccaccctctgcgaagatgtacaacgctccgtcggggcaggagatgtcctacacggaccatgtgcagaagcgccacgaggagaagggctgcatctacgcatgcgtgttcacggcgctgtgctgcttctgctgctacgagacctgtgagtgctgcctcgattgcctctgctgctgctgcaactaaaccagccatggtcaccatggacggacagacggacggagaaaggtgcagcgcgagatcgaccggcctccactactgttaattatcccccaaaaaaatttacaatttcgtaataagctagctagcagcttagctcgatgagaactgtatcaggtaccgcataatattatctgcaccagacaacactatcactataatcagttaatcaccatccatcatggtttgtgttgcatcttaaaaaaaaaa

SEQ ID NO: 1952 - DNA, 513 bp, Triticum aestivum
gagagagagagagagagagagagagagagagagagagagagagagagagagaccaaagccggtcacaggagagcagagcagaatccttggagagtatcttcttctttccatagtagcccaccccaccctttgccaagatgtacaacgcaccgtcggggcaggagatgtcctacacggagcacgtgcagaagcgccacgaggagaagggctgcatctacgcatgcgtgttcacggcgctgtgctgcttctgctgctacgagacgtgcgagtgctgcctcgactgcctctgctgctgctgcaactaaaccagccatggccgccatggccgccatggacggaggccgcaaggcgcagcggagatccaggcaccggcctccgccgccgcctttcataataagcatatgtgtctagtgtcttagctcgatgagaagtgtatcagaagttgctataatactatctgtccatcatggtttgtgttgttgttgctgctactgcttctcaccaaaaaaaaaa

SEQ ID NO: 1953 - DNA, 488 bp, Triticum aestivum
tcggcacgaggcagacaagagcacaacccttggagactttcttcttccatagtaacccaacccacccttcgccaagatgtataaccctccgtcggggcaggagatgtcctacacggaccacgtgcagaagcgccacgaggagaagggctgcatctacgcatgcgtgttcacggcgctgtgctgcttctgctgctacgagacgtgcgagtgctgcctcgactgcctctgctgctgctgcaactagaccaggctgccgtgcccgacatggacggaggccgcaaggcgcagcggagacccaccggcctccaccgtcgcctttcataataagcatatgtgtctagtgccttagctcgatgagaactgtatcagatattgctgtaatactatatgcccaggacaaggctatcactgtaaacatcgattatggtttgtgctgcatcttaatttaattagcatcagattccggttccctggcatcaaaaaaaaaa

SEQ ID NO: 1954 - DNA, 519 bp, Triticum aestivum
  misc_feature (426)..(426): n is a, c, g, or t
  misc_feature (444)..(444): n is a, c, g, or t
  misc_feature (471)..(471): n is a, c, g, or t
gttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttttgtgtgtgtgtgccgcatcttcatttgcactggaaaatgctttatanttgtgaaggctgtaatcngttgtatgtacttggcagatgaactcnatattgtgccatatatctcgcttgattggacaaatcctttcgaagttt

SEQ ID NO: 1955 - DNA, 514 bp, Triticum aestivum
tcgacccacgcgtccgcggacgcgtgggcaggagagcaggcagagcacaacccttggagacctcttcttcttccatagtaacctaacccaccctctgcgaagatgtacaacgctccgtcggggcaggagatgtcctacacggaccatgtgcagaagcgccacgaggagaagggctgcatctacgcatgcgtgttcacggcgctgtgctgcttctgctgctacgagacctgcgagtgctgcctcgactgcctctgctgctgctgcaactagaccaggctgccgtgcccgacatggacggaggccgcaaggcgcagcggagacccaccggcctccgccgtcgcctttcataataagcatatgtgtctagtgccttagctcgatgagaactgtatcagatattgctgtaatattatatgcccaggacaaggctatcactgtaaacatcgattatggtttgtgctgcatcttaatttaattagcatcagattccggttccctggcatcaaaaaaaaaa

SEQ ID NO: 1956 - DNA, 569 bp, Triticum aestivum
gagcagagcacaacccttgtccatagtcacacaacccaccctttgcgaagatgtataacgctccgtcggggcaggagatgtcctacacggaccatgtgcagaagcgccacgaggagaagggctgcatctacgcatgcgtgttcacggcgttgtgctgcttctgctgctacgagacgtgcgagtgctgcctcgactgcctctgctgctgctgcaactaaaccagccatggtcaccatggacggacggacggacggagaaaggtgcagcgcgacatcgaccggcctccactactgttaattatcccaaaaccaaaattacaatttcgtaataagctagctctgatgagaactgtatcaggtaccgcataatattatctccaccagacaagactatcactataatcaccatccatcatggtttgtgttgcatcttattttaattagcatcagattctggtcctcacctgcccactgcgcttttcctttgacactttgctttgtctccctgtaattatctgaagactgaaatgaacatttcattaaataaaattatgtgactgaaaaaaaaaa

SEQ ID NO: 1957 - DNA, 523 bp, Triticum aestivum
  misc_feature (276)..(276): n is a, c, g, or t
  misc_feature (419)..(419): n is a, c, g, or t
  misc_feature (461)..(461): n is a, c, g, or t
  misc_feature (467)..(467): n is a, c, g, or t
ctaaatctagccggagagaggagaggagcccagccggccggcggcaagatgtacaacaaccctccgccaccgcagggcatgtcctactacgagcacgcgcagaagcgccaccaggagaagggatgcctctacgcgtgcgtgttcacggcgctgtgctgcttctgctgctacgagacgtgcgagtgctgcctcgactgcctctgctgctgctgcaactaaaccaaccatggccgccatggccgccatggacggaggccgcaaggcgcagcggagatncaggcaccggcctccgccgccgcctttcataataagcatatgtgtctaatgtcttagctcgatgagaagtgtatcaaaaagtttgctataataactatctgtccaacaatgggtttgtgtttgttgtttgctggctaactgcnttctcaacaaatcactggtgtcgttttcccaaatttgttttncctccncaaccccctgaaaattatcttcctaaaattaccgaaattaaacaatgtgcaaacct

SEQ ID NO: 1958 - DNA, 497 bp, Triticum aestivum
ccacgcgtccgcaacttgacaaggtagaagagatcaaaaactagccggagagaggagaggagcccggcctgccggcggcgagatgtacaacaaccctccgccgccgcaaggcatgtcctactacgagcacgcgcagaagcggcacgaggagaagggctgcctctacgcatgcgtgttcacggcgctgtgctgcttctgctgctacgagacctgcgagtgctgcctcgactgcctctgctgctgctgcaactagaccaggctgccgtgcccgacatggacggaggccgcaaggcgcagcggagacccaccggcctccgccgtcgcctttcataataagcatatgtgtctagtgccttagctcgatgagaactgtatcagatattgctgtaatattatatgcccaggacaaggctatcactgtaaacatcgattatggtttgtgctgcatcttaatttaattagcatcagattccggttccctggcatcaaaaaaaaaa

SEQ ID NO: 1959 - DNA, 536 bp, Triticum aestivum
gagagcagagcagagcggaaaagaaagaaagaaacccttgctagttgttcttccatagtaacccaccctttacaaacaatacaaagccggccatgtacgacgctccgtcggcgcaggagatgtcctacatggatcacgtgcagaggcgccatgaggagaagggctgcatctacgcatgcgtgttcatggcgctttgctgcttctgctgctacgagacctgcgagtgctgcctcgactgcctctgctgctgctgtaactaaactagccatggccgccactggacagacagacgacggataaaggcgcgccgagatccaccaccggcctcttctgtctttaattaccccgacagtttttgatttttttaataataaacatgtgtgtctagctctcaacttagctcgatgagtgctttatcgatattgcaatagtagtattatctgcccccgacaagactatcactgtaatgatccatcatcgtgtttgttgcatctttatttaattagcatcagattatggttccccgaaaaaaaaaa

SEQ ID NO: 1960 - DNA, 485 bp, Triticum aestivum
  misc_feature (14)..(14): n is a, c, g, or t
  misc_feature (60)..(60): n is a, c, g, or t
gggcaggagatgtnttacacggaccatgtgcagaggcgccacgaggagaagggctgcctntacgcatgcgcgttcacggcgctgtgctgcttctgctgctacgagacgtgcgagtgctgcctcgactgcctctgctgctgctgcaactaaaccagccatggtcaccatggacgggcggacggacggacaaaggtgcagcgcgagatcgaccggcctccactactgttaattatcccccaaaaaaatttacaatttcgtaataagctagctagcagcttagctcgatgagaactctatcaggtaccgcataatattatctttaccagacaagactatcactataatcaccatccatcatggtttgtgttgcatctttttttaattagcatcagattctggtcctcacctgcccactgcgcttttcctttgacactttgctttgtctccctgtaattatctgaagactgaaatgaacatttcattat

SEQ ID NO: 1961 - DNA, 488 bp, Triticum aestivum
caaagccggccacgggagagcagagcagaatccttggagagtatcttcttcttccatagtaacccactccaccctttgccaagatgtacaacgctccgtcggggcaggagatgtcctacacggagcacgtgcagaagcgccacgaggagaagggctgcatctacgcatgcgtgttcacggcgctgtgttgtttctgctgctatgagacctgcgagtgctgcctcgactgcctctgctgctgctgcaactaaaccaggccgccatggacggaggccgcaaggcgcagcggaggtcgaccggcctccgccgccgcctttcataataagcatatgtgtctagtgtcttagctccatgagaagtgtatcagaagttgctataatactatctgtccatgtggtcatccatcatggtttgtattgttgctgctgctactgctctaccattttaatttgattagcatcagattatggttctcaccaaaaaaaaaa

SEQ ID NO: 1962 - DNA, 1033 bp, Hordeum vulgare
ttgatcccctccaaccagatctgacgccgccgccgcgcagcaaaacccgagcgcggcctccccccgatcggaagcggcctcacctgcggcgagcggagcggagcgggtcgcgatgggcgtggagtgccggtacgaggtcgcgcaggcggcgtacgtcaagctcgcgctgcacgcgctcaagcacccggcggccgccgtcaacgggctcctcgtcggccgcctggcagacccggccgcctccccggccgccgttgtctcggtcgccgacgccgtgccgctctcccaccagccgcaccacctcccgctgctccccacgctcgagctcgcgctcaccctcgtcgaggaccacttccagccgcagggcctcgccgtcgtcgggtactaccacgccaacgcccgccgcgacgacgccgacctccccgccgtcgccaagcgcgtcggggaccacatcttccgctacttcccccgcgccgccgtcctgctgctggacaacgtgaagctcgaggaggtggtcaaggggaacagccgcgacgctgttgttcagctatacaccagggattcatcaaaaagctggcgtcaggctggatcagatggaagtagtcagctcaaactgaaagagccatctaccaatgtggtcttagctgaccatgttaccacgaagaaatggcagcaagttgttgattttgacgaccacctcgatgatattagcaaggactggttgaacgcaagcctgcttggttgaaacggttttgagatcaaatttgtcacatatttattttgaactggctagaaaccaaggcatcaaggcttgtcccaccagatcactttgtttcacttgatggccagacgagctatttggcatggttttgtaatttaatatgatataataagtagatgttaccccatgtgttcttgcgacgatttgtagccaaaaatatattgaaaaatgaagaaaaactgtgattgtaaaagggagcaaaagcttacaccaagggcgtgggggtcatcagaagaaatgcccttgtttcttgtc

SEQ ID NO: 1963 - DNA, 957 bp, Brachypodium distachyon
gatctcctcagaccagatctgacggaaaaacaagaaagcccttgagcagttgagccaagaaatcctttccccgatctgatcggaagcagacaacggcggctgcggcggcggtagagcggagcaggtcgcgatgggtgtcgagtgccgctacgaggtagcgcaggcggcgtacgtcaagctagcgctgcacgcactcaagcaccccacggccgccgtcaacggactcctcgtcggccgcctcctcgactcggcctccccggccgtcgtctcagtcgtcgacgccgtcccgctctcacaccaaccgcaccacctcccgctactcccgacgctcgagctcgcgctcacgctcgtggaggaccacttcgcgccgcagggcttcgccgtcgtcggctactaccacgccaacgcgcgccgcgacgacaccgaccttccagctgttgccaagcgcgtcggggaccacatcttccgctacttccctcgcgccgccgtgctgctgctggacaaccagaagctggagaaggtgatcaagggggatagccgcgacccagttgttcagctatattccagggattcatcaaaaagctggcgccaggctggatcagatggaagtagtcagctcactttaaaagaaccatctaccaatgtggtcttagctgatcatgttacaacgaagaagtggcagcaaattattgactttgatgaccaccttgatgatattagcaaggattggttgaaccctagcctacttggttgaaacagttttgtgattttaatcgttatatatttattcaatctcgatagaaccgaaggctcgtcccaccaaatcattacattgactatatagctagacgagttgtttgatttggtttgtaatttacttaatgtgacaaatagatattaccctttgtgttccaccggaactctgcagacaaaaattgatgaaaactaaagttttgc

SEQ ID NO: 1964 - DNA, 1110 bp, Oryza sativa
ggccagaagcaacctacacaaccttccaatccaagaccgatcagataccccgatcctcccgaaccccaaatcagatctcacacgctttggagcgaacagtccaaggagcagagcagccttcctcttcctctcttctccgatcggaagcaggcgcggcggcggtagcggaagcggcagtcgccgtaggagcggatcgcgatgggagcggagtgcaagtacgaggtggcgcaggtggcgtacgtcaagctcgcgctgcacgccctcaagcaccccgccgccgccgtcaacggcctcctcgtcggccgcctcctcgacggggccgcctcccccgccgccgtcgtctccatcgccgacgccgtgccgctctcccaccacccgcaccacctcccgctgctccccaccctcgagctcgcgctcacgctcgtcgaggaccacttcgccgcgcagggcctcgcggtcgtcggctactaccacgccaacgcgcgccgcgacgacgccgacctcccgcccgtcgccaagcgcgtcggggaccacgtcttccgcaacttcccccgcgccgccgtactcctgcttgataacaagaagctggaggaggcagtcaaggggaagagtcgcgagccagtcgttcagctatacactagggattcatcaaaaagctggcgtcaggctggatcagatggaagtagtcagctgactttaaaagaaccatcaaccaatatggtcttagccgatcatgttacaacgaagaaatggcagcaagttgttgatttcgatgaccacctcgatgatattagcaaagattggttgaacccagggctacttgcttgaaataattatgtgctttgatatttttatacttgttggtaccaatatgttgaggctcgtctcaccagattattgcggttctctctatagctagacgagttatttgacagggtttgtacttaaatatggacaagtaatttttgtaacaaactgtagcatgtgaaaatgcttagatctgcattaagattactggcgttcatgccatttcttccctcttatctctcttggaaaattggtatcggaacattctggttctacaacaggtaagacgtgcattatttctcc

SEQ ID NO: 1965 - DNA, 771 bp, Secale cereale
ggaaccaccggcggcggcggcagagcggagcggatcgcgatgggcgtggagtgccggtacgagctcgcgcaggcggcgtacgtgaagctcgcgctgcacgcgctaaagcacccggcggccgccgtcaacgggctcctcgtcggcactctggcggacacggccgcctccccggccgtcgtctcggtcgtcgacgccgtgccgctctcccaccagccgcaccacctcccgctgctccccaccctcgagctcgcgctcaccctcgtcgaggaccacttccaggcgcagggcctcgccgtcgtcggctactaccacgccaacgcgcgccgcgacgacgccgacctccccgccgtcgccaagcgcgtaggggaccacatcttccgctacttcccccgcgccgccgtgctgctgctcgacaacgtgaagctcgaggaggtggtcaaggggaacagccgcgacgcagttgttcagctatacaccagggattcatcaaaaagctggcgtcaggcggggtcagatggaagtagtcagctcaaactgaaagagccatctaccaatgtggtcttagctgatcatgttaccacaaagaaatggcagcaagttgttgattttgatgaccacctcgatgatattagcaaggactggttgaacgcaagcctacttggttgaaacggttttgtgatttcacgtgtcacatatttattttgaactggctagaaaccaaagcgtcaaagcttgtttgtcccaccaaatcactgcctttcacttgatggc

SEQ ID NO: 1966 - DNA, 1198 bp, Sorghum bicolor
agcagggcaccactcgcccgctccagcagtccagctcctccgacgcgcgaccagacgctcgccctcgccagtcccagtcgccatacccagaggcccagaccccgtccggcgcccgccgattcgacgcgagtacgcgacgcgccgcgccggccgccggcggcttccccagatccacgcgccgctcggcgacccggccgctcggagctcgctccggccgtccgcccgcagcccgccaaaaatcatcctcggatcggaatcagcggagcgacggcggagatgggcgcggattgccggtacgagctggcgcaggcggcgtacgtcaagctggcgctgcacgcactgaagcacccagcgaccgccgtcaacggcctcctcgtcggccgcctcgtcgagccttcgtcctcaccggccgtcgtctcggtcatcgacgccgtgccgctgtctcaccacccgcaccacctgccgctgctccccacgctcgagctcgcgctcaccctcgtcgaggaccacttcgcaacccagggcgaaggcctcgccgtcgtcggatactaccacgccaacccgcgctgcgacgacaccgacctcccgccagttgccaagcgcgtcggggaccatatcttcagatacttcccccgctccgccgtgttgttggtcgataacaagaagctggaggaggccgtcaaggggaagtctcgtgacccggtggctcagttatacaccagggattcatcaaaaagttggcgtcaggctggatcagatggaagcagtcagcttgttctgaaagaaccttctaccaatgttgtcctagctgatcatgttacaacaaagaaatgggagaaaattgttgattttgacgaccaccttgatgatattagcaaggattggttgaacccaggcctgcttgactgaattttcacgattgatctctctatactgtattggaactttgctagaaatgaggtggtgaagctcgtcctgctgtactctggactttgctcagtcgcaatgatttataagcatgtatttcagtaaacaagtgattttgtaacagttacagttcgaaatgctaaaattgacgttgagatgacatttgagtagatttatccctgcggcatattattacgacttgtcaaaggaaacttcatcacatataaatttaagaggctgtttggatcctttcattttgaagcaattggtg

SEQ ID NO: 1967 - DNA, 1049 bp, Sorghum bicolor
ctcacgctcctgtaaccaaaacaaaatcagcatccgatccccaccaaaaatcatcctcctaagtcggaacgaaatcagcggcgtcggagatgggcgctgagtgccggtacgaggtggcgcaggcggcgtacgtcaagctggcgctgcacgcactgaagcaccccgcgaccgccgtcaacggcctcctcgtcggccgcctcgtcgagccttcgtcgtcaccggccgtcgtctcggtcatcgacgccgtgccgctgtctcaccacccgcaccatctggcgctgctccccacgctcgagctcgcgctcactctcgccgaggatcacttcgcaacccagggcgaaggcctcgccgtcgtcggatactaccacgccaacccgcgctgcgacgacactgaactcccgccagtcgccaagcgcgtcggggaccacatcttccgatacttcccccgctccgccgtgttgctggtcgataacaagaagctggtggaggccgtcaaggggaagtctcgcgatccggtggttcagctatacaccagggattcatcaaaaagttggcgtcaggctggatcagatggtagcagtcagctggttctaaaagaaccttctaccaatgttgtcctagctgatcatgttacaacaaagaaatgggagaaaattgttgatttcgacgagcaccttgatgatattagcaaggattggttgaacccaggcctccttgactgacttttcatgattgatctctctatagatactgtattggaactttgctagaaatgaggtggtgaagtttgtcctgctgtgctatggactttgctcagtcgcaatgacttataagcatggattttaatgtaaacaagtgattttgtaacaactacagatcaaaatgctaaaattgacgttgagaagatattttagtagattcattcctgtggcatattaattatgaagacctcgagattgtctcaagacatgacaattattactgacttgtcacatgcaatctttgttcatacaatctttgctcatacatgagtcatttttaaagaagga

SEQ ID NO: 1968 - DNA, 829 bp, Saccharum officinarum
  misc_feature (708)..(708): n is a, c, g, or t
  misc_feature (715)..(715): n is a, c, g, or t
  misc_feature (718)..(718): n is a, c, g, or t
  misc_feature (739)..(739): n is a, c, g, or t
  misc_feature (754)..(754): n is a, c, g, or t
  misc_feature (757)..(758): n is a, c, g, or t
gcggcggagatgggcgcggagtgccggtatgagctggcgcaggcggcgtacatcaagctggcgctgcacgcactgaagtacccggcgaccgccgtcaacggcctcctcgtcggccgcctcgtcgagccttcgtcctcaccggccgtcgtctcggtcatcgacgccgtgccactgtctcaccacccgcaccacctgccgctgctccccacgctcgagctcgcgctcaccctcgtcgaggaccacttcgcaacccagggcgaaggcctcgccgtcgtcggatactaccacgccaacccgcgctgcgacgacaccgacctcccgccagttgccaagcgcgtcggggaccatatattccgatacttcccccgctccgctgtgttgttggtcgataacaagaagctggaggaggccgtcaaggggaagtctcgcgacccggtggttcagttatacaccagggattcatcaaaaagttggcgtcaggctggatcagatggaagcagtcagctggttctgaaagaaccttctaccaatgttgtcctagctgatcatgttacaacaaagaaatgggagaaaattgttgattttgacgaccaccttgatgatattagcaaggattggttgaacccaggcctccttgactgaattttcacgattgatctctctatactgtattggaactttgctagaaaggaggtggtgaagctcgtnctgtgtnctntggactttgctcagtcgcaangagttataagcatgnatnncattttaatgtaaacaagtgattttgttacagttacagttcaaaatgctaaacttgaccttcagatgatat

SEQ ID NO: 1969 - DNA, 728 bp, Saccharum officinarum
  misc_feature (551)..(551): n is a, c, g, or t
  misc_feature (577)..(577): n is a, c, g, or t
atctccctcgaatcagatctcacgcccctgcaaggctgcaaccaaaacaaaatcagcatccggatccccaccaaaaatcatcctcggaacgaaatcagcgccggagatgggcgcggagtgtcggtacgatgtggcgcaggcggcgtacctcaagctggcgctgcacgcactgaagcacccggcgaccgccgtcaacggcctcctcgttggccgcctcgtcgagccttcgtcctcaccggccgtcgtctcggtcatcgacgccgtgccgctgtctcaccacccgcaccacctgccgctgctccccacgctcgagctcgcgctcactctcgtcgaggaccacttcgcaacacagggcgaaggcctcgccgtcgtcggatactaccacgccaacccgcgctgcgacgacaccgaactcccgccagtcgccaagcgcgtcggggaccacatcttccgatacttcccccgctccgccgtgttgctggtcgataacaagaagctggaggaggccgtcaaggggacgtctcgcgatccggtggttcagttatacaccnaggattcatcaaaaagttggcgtcangctggatcagatggaagcaagcagcttggtctaaaagaaccttctaccaatgtagtcctagctggacatgtacaacaaagaaatgggaaatattggtgaatttcacgaccaccttgatgatttagcaaggattgttggacccagccctcct

SEQ ID NO: 1970 - DNA, 1086 bp, Panicum virgatum
agcaaatctgacatctccaaatcagatctaaagtctcagcaagcgaaagctgcacccccgaatccccccaacaagaaatcctcctgctatcggattcagcagctgcggagccggagatgggcgcggagtgccggtacgaggtggcgcaggcggcgtacgtcaagctcgcgctgcacgcgctcaagcacccgtccgccgccgtcaacggcctcctcgtcggccgcctcgtggagccctcctccaccccggccgtcgtctccgtcgtcgacgccgtgccgctgtcccaccacccgcaccacctgccgctgctccccacgctcgagctcgcgctcactcttgttgaggaccacttcgcgacccaaggcgaaggcctcgccgtcgtcgggtactaccacgccaacccgcgccgcgacgacgccgatctcgcccccgtagccaagcgcgtcggcgaccacatcttccggtacttcccccgctcggccgtgctgctggtcgataacaagaagctggaggaggctgtcatggggaagtctcgcgagcctgtagttcagttatacaccagggattcatcaaaaagttggcgtcaggctggatcggatgggagcagtcagctggctctaaaagaaccttctaccaatgttgtcctagctgatcatgttacaacaaagaaatgggagaaaattgttgatttcgatgaccaccttgatgatattagcaaggattggttgaacccaggtctccttgattgaagttttatgatttgatcactttaatacttcattggaacttctctagaaatgaggtggtgaagctgtatcacattatttgatctgtatgatggatatcgctcgaaagcaacatggattttaatgtagacaattgattttgtaacaattatagcctatcaaaattctaaggtcggcatggagatgatgtttaagcatagattaacctttgaccattcatccgtgaggaccatattataagcaaagacctcgagacaggtgcgccattgacagcgatggctgctcgttgctcatctttcctatccaaaagttacataaaatagaaaaaaaaaactttccc

SEQ ID NO: 1971 - DNA, 986 bp, Triticum aestivum
  misc_feature (593)..(593): n is a, c, g, or t
atcccctccacccagatctgacgacggccgccgcgcacgagagaggcagcgaaaacccgaccggaagcggcctccccggcggatcgcgatgggcgtggagtgccggtacgaggtcgcgcaggcggcgtacgtgaagctcgcgctgcacgcgctcaagcacccggcggcggccgtcaacgggctcctcgtcggccgcctggcggacccggccgcctccccggccgtcgtctcggtcgccgacgccgtgccgctctcccaccagccgcaccacctcccgctgctccccacgctcgagctcgcgctcaccctcgtcgaggaccacttccaggcgcagggcctcgccgtcgtcggatactaccacgccaacgcgcgccgcgacgacgccgacctccccgccgtcgccaagcgcgtcggggaccacatcttccgctacttcccccgcgccgcggtgctgctgctggacaacgtgaagctcgaggaggtggtgaaggggagcagtcgcgatgccgttgttcagctatacaccagggattcatcaaaaagctggcgtcaggctggatcagatggaagtagtcagctcaaactgaaagagncatctacaaatgtggtcttagctgatcatgttaccacgaagaaatggcagaaagttgttgatttcgacgaccacctcgatgatatcagcaaggactggttgaacgcaagcctgcttggttgacacggttttgagatcaaatttgtcacatatttatttgaactggctagaaaccaaggcgtcaaggcttgtcccaccagatcagcgtgtttcacttgatggccaggcgagctatttggcatggttttgtaatttaatatgatataataagtagatgttaccccatgtgttcttgcaacaatttgtagccaaaaattgatggaaaatgaagaaaaactgtgattgtaaaagggagcaaaggttacatcaatggcgttgtcgtcatcacaggaaa

SEQ ID NO: 1972 - DNA, 1052 bp, Triticum aestivum
ccacgcgtccgaagccgatctgactgatactctctccgatcccctcgacccagatctgacgacggccgccgcgcacgagagaggcggcgaaaacccgatcggaagcggcctcaccggcggatcgcgatgggcgtggagtgccggtacgagctcgcgcaggcggcgtacgtgaagctggcgctgcacgcgctcaagcacccggcggcggccgtcaacgggctcctcgtcggaactctggcggacccggccgcctccccggccgtcgtctcggtcgccgacgccgtgccgctctcccaccagccgcaccacctcccgctgctccccacgctcgagctcgcgctcaccctcgtcgaggaccacttccaggcgcagggcctcgccgtcgtcggctactaccacgccaacgcgcgccgcgacgacgccgacctccccgccgtcgccaagcgcgtcggggaccacatcttccgctacttcccccgcgccgccgtgctgctgctggacaacgtgaagctcgaggaggtggtcaaggggaacagccgcgacgcagttgttcagctatacaccagggattcatcaaaaagctggcgtcaggctggatcagatggaagcagtcagctcaaactgaaagagccatctaccaatgtggtcttagctgatcatgttaccacgaagaaatggcagcaagttgttgatttcgacgaccacctcgatgatatcagcaaggactggttgaacgcgagcctgcttggttgaaacggttttgagatcaaatttgtcacatatttatttgaactggctagaaaccaaggcatcaaggcttgtcccaccagatcactgcgtttcactttatggccagacgagctatttggcatggttttgtaatttaatatgacataataagtagatgttaccccatgtgttcttgcgatgatttgtagccaacaactgatgaaaaatgaagaaaaactgtgattgtaaaagggggcaaaagcttacatcaatggcgttgtcgccatcacaggaaatgtccttgtgtcctgtcaaaaaaaaaa

SEQ ID NO: 1973 - DNA, 1293 bp, Oryza sativa
gagtgtagcttcctccctagctgtccgcgactccgcgaccgacggcggcggcggcagatggagaggaaccagcaccgcgacggcgacggcgacggtgagggacgccatcatcatgtcgtccaggtcccagcgtcagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcgatgctcacagcgttcccggcgtcgagcctcctgtcgcggctgtactacaacaacggcgggcagagcaagtggatcctgtcgtggtccgccgtcgccggctggccgctgccggcgctcctcctgctgccgtgctacctcgccggcaaggcggcgccgacgccgctgtcgccgaagctgtgcgcctggtacgcgctgctcggcctcctgagcgccgccgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtccgggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaacatgaaaaatatgtgaactgagtatgttcttgtattgaccaa

SEQ ID NO: 1974 - protein, 495 aa, Brachypodium distachyon
MKLRSTAITRANSACLPMEDRGCFKYNGVNEGEEERKGGHGIPKVSMVPLIFLIFYEVSGGPFGIEDSVKAAGPLLAIVGFLLFALIWSVPEALITAEMGTMFPENGGYVVWVSSALGPFWGFQQGWAKWISGVIDNALYPVLFLDYVKSSIPALGGGLPRTFAVLILTVALTYMNYRGLTIVGWVAVFLGVFSLLPFFVMGLIAIPRIEPSRWLEMDLSNVNWSLYLNTLFWNLNYWDSISTLAGEVENPKRTLPKALSYALVLVVGGYLYPLITCTAALPVVRESWTDGYFSDVAKILGGFWLHSWIQAAAALSNMGNFVTEMSSDSYQLLGMAERGMLPEFFAKRSRHGTPLVGILFSAFGVVLLSWMSFQEIIAAENYLYCFGMILEFIAFIKLRMTHPNTSRPYRIPLGTVGAVLMIIPPAILIIVVMALASFKVMAVSILAVLIGFALQPSLVYVEKKRWLRFSVSEDLPELPDSSPVADGDETVPLVI

SEQ ID NO: 1975 - protein, 476 aa, Zea mays
MGDRVGVKYNSINEAEEHKGGHGIPKVSMIPLIFLIFYEVSGGPFGIEDSVKAAGPLLAILGFLLFALIWSVPEALITAEMGTMFPENGGYVVWVSSALGPFWGFQQGWAKWLSGVIDNALYPVLFLDYVKSSVPALGGGLPRTLAVLILTVALTYMNYRGLTIVGWVAVFLGVFSLLPFFVMGLIAIPQIEPSRWLEMDLGSVDWGLYLNTLFWNLNYWDSISTLAGEVENPKRTLPRALSYALVLVVGGYLYPLITCTAAVPIVREHWSDGYFSDIARILGGIWLHSWIQAAAALSNMGNFLTEMSSDSYQLLGMAERGMLPDFFAKRSHYGTPLIGILFSAFGVILLSWMSFQEIIAAENYLYCFGMILEFIAFIKLRVYHPNASRPYKIPLGTIGAILMIIPPGLLIIVVMALASYKVMVVSILAMVFGFVLQPCLVYVEKKRWLRFSISADLPDLPDVQEIAEDDAVPLVV

SEQ ID NO: 1976 - protein, 476 aa, Pennisetum glaucum
MGDRVAVKYNSVNDGEERKGGHGIAKVSMVPLIFLIFYEVSGGPFGIEDSVKAAGPLLAIAGFLLFALIWSIPEALITAEMGTMFPENGGYVVWVSSALGPFWGFQQGWAKWLSGVIDNALYPVLFLDYVKSSIPALGGGLPRTLAVLILTVALTYMNYRGLTIVGWVAVFLGVFSLLPFFVMGLIAIPRIEPSRWLEMDLGTVNWGAYLNTLFWNLNYWDSISTLAGEVENPKRTLPRALSYALVLVVGGYLYPLITCTAAIPIVRERWSDGYFSDIAGILGGVWLHTWIQGAAALSNMGNFLTEMSSDSYQLLGMAERGMLPEFFAKRSRYGTPLIGILFSAFGVILLSWMSFQEIVAAENYLYCFGMILEFIAFIKLRVTHPDASRPYKIPLGTIGAVLMIIPPTILIVVVMALASFKVMAVSIMAMIVGFVLQPCLVYVEKRRWLRFSISADLPDLPDSQQATEEDTVPLVL

SEQ ID NO: 1977 - protein, 476 aa, Sorghum bicolor
MGDRVGVKYNSVNEGEERKGGHGIPKVSMVPLIFLIFYEVSGGPFGIEDSVKAAGPLLAIVGFLLFALIWSIPEALITAEMGTMFPENGGYVVWVSSALGPFWGFQQGWAKWLSGVIDNALYPVLFLDYVKSSVPALGGGLPRTVAVLILTVALTYMNYRGLTIVGWVAVFLGVFSLLPFFVMGLIAIPRIEPSRWLEMDLGNVDWGLYLNTLFWNLNYWDSISTLAGEVENPKRTLPRALSYALVLVVGGYLYPLITCTAAVPVVREYWSDGYFSDIARILGGIWLHSWIQAAAALSNMGNFLTEMSSDSYQLLGMAERGMLPDFFAKRSHHGTPLIGILFSAFGVILLSWMSFQEIIAAENYLYCFGMILEFIAFIKLRVTHPNASRPYKIPLGTIGAVLMIIPPAVLIIVVMAIASYKVMAVSILAMVIGFVLQPCLGYVEKKRWLRFSISADLPDLPDAQETAEDDAVPLVF

SEQ ID NO: 1978 - protein, 493 aa, Panicum virgatum
MKLRNTAITRANSACLPMGDHLDFKYNSVNEGDERKGGHGIPKVSMVPLIFLIFYEVSGGPFGIEDSVKAAGPLLAIVGFLVFALIWSIPEALITAEMGTMFPENGGYVVWVSSALGPFWGFQQGWAKWLSGVIDNALYPVLFLDYVKSSVPALGGGFPRTLAVLILTVALTYMNYRGLTIVGWVAVFLGVFSLLPFFVMGVIAIPRIEPSRWLEMDLGSVNWGLYLNTLFWNLNYWDSISTLAGEVENPKRTLPRALSYALVLVVGGYLYPLITCTAAIPVVREQWSDGYFSDIARILGGIWLHSWIQGAAALSNMGNFLTEMSSDSYQLLGMAERGMLPEFFARRSRHGTPLIGILFSAFGVILLSWMSFQEIIAAENYLYCFGMILEFIAFIKLRMTHPNASRPYKIPLGTIGAVLMIIPPALLIVVVMALASFKVMAVSIMAMIVGFVLQPCLVYVEKKRWLRFSISGDLPDLPDSQEAAEDDTVPLAF

SEQ ID NO: 1979 - protein, 226 aa, Triticum aestivum
  misc_feature (2)..(2): Xaa can be any naturally occurring amino acid
MXLDNVNWGLYLNTLFWNLNYWDSISTLAGEVENPKRTLPRALSYALVLVVGGYLYPLITCTAALPVVRESWTDGYFSDIAKILGGFWLHSWIQAAAALSNMGNFVTEMSSDSYQLLGMAERGMLPEFFGKRSRYGTPLIGILFSAFGVVLLSWMSFQEIIAAENYLYCFGMILEFIAFIKLRMTHPSTSRPFRIPLGTVGSVLMIIPPTILIVVVMVLASFKVMA

SEQ ID NO: 1980 - protein, 522 aa, Hordeum vulgare
MASAYDREDGLAPPQPHGGGPADAYDPNYVPDSVKTFVVHLYRHIRDKNVYEIHQMYEGGFQRLSDRLFRDTPWPSAEAVAPYCDGDHVFLLLYRELWYRHAYARLSPLTASHRSESWNNYCDLFSVVLHGVVNMQLPNQWLWDMVDEFVYQFQSFCQYRAKLKNKTEDELQQLKQFDKAWNVYGVLNYLQALVEKSMIAQILEREKEGLESFTATDGYDYQGGSNVLKVLGYYSMIGLLRIHCLLGDYHTGLKCLAPINLNQQGVYTIVIGSHISTIYHYGFANLMMRRYVDATKEFNKILLYIIKYKQYHQKSPQYDQILKKNEQMYALLAICLSLCPQNKLIDENVSTQLKEKYNDKMTKMQRFDDEAYAAYDELFSYACPKFITPSPPVLDQPLTNYNQDAYRLQLKLFLYEVKQQQLLSGIRSYLKLYSAITITKLAQYMEMDEATLRSILMTYKHKMHAVDSNGKIVSSADFDFYINEDVIHVVESKSTKRHGDYFLRQILKFEETIAELDKVQLD

SEQ ID NO: 1981 - protein, 521 aa, Brachypodium distachyon
MASAYDREDGTAPPSHGGGAADAYDPNYVPDSVKTFVVHLYRHIRDKNVYEIHQMYEGGFQRLSERLFRDTPWPSAEAVAPYCDGDHVFLLLYRELWYRHAYARLSPLTASHRSESWNNYCDLFSVVLHGVVNMQLPNQWLWDMVDEFVYQFQSFCQYRAKLKNKTDDELQQLKQFDKAWNVYGVLNYLQALVEKSMIAQILEREKEGLEQFTATDGYDYEGGSNVLKVLGYYSMIGLLRIHCLLGDYHTALKCLAPINLNQQGVYTIVIGSHISTIYHFGFANLMMRRYVDATREFNKILLYILKYKQYHQKSPQYDQILKKNEQMYALLAICLSLCPQNKLIDENVSTQLKEKYNDKMTKMQRFDDEAYSAYDELFSYACPKFITPSPPVLDQPLTNYNQDAYRLQLKLFLYEVKQQQLLSGIRSYLKLYSAITISKLAQYMEMDEATLRSILLTYKHKMHAVDSNGKIVSSADFDFYINEDIIHVVESKPTKRHGDYFLRQILKFEETIAELEKVQLD

SEQ ID NO: 1982 - protein, 520 aa, Cenchrus ciliaris
  misc_feature (128)..(128): Xaa can be any naturally occurring amino acid
  misc_feature (291)..(291): Xaa can be any naturally occurring amino acid
MAAPYDREDGLPPAPPHHAHDAYYPNYVPDSVKTFVVHLYRHIRDKNVYEIHQMYEGGFQRLSDRLFRDAPWPSAEAVAPYCDGDHVFLLLYRELWYRHAHARLSPLTAAHRAESWTNYCDLFSVVLXGVVNMQLPNQWLWDMVDEFVYQFQSFCQYRAKLKNKTEDELNQLKQFDKAWNVYGVLNYLQALVEKSMITQILEREKEGLEQFTATDGYDYEGGSNVLKMLGYYSMIGLLRIHCLLGDYHTGLKCLAPIDLNQQGVYTIVIGSHISTIYHYGFANLMMRRYVXATREFNKILLYILKYKQYHQKSPQYDQILKKNEQMYALLAICLSLCPQNKLIDENVSTQLKEKYNDKMTKMQRYDDEAYAAYDELFSYACPKFITPSPPVLDQPLTNYNQDAYRLQLKLFLYEVKQQQLLSGIRSYLKLYSTITIGKLAQYMEVDEATLRSILMTYKHKMHAVDSDGKIVSSADFDFYIVEDVIHIVESKPTKSHGDYFLRQILKFEEMMGELEKVQLD

SEQ ID NO: 1983 - protein, 522 aa, Zea mays
MAAAHYDREDGLPPSAPPHAAADAYDPNYVPDSVKTFVVHLYRHIRDKNVYEIHQMYEGGFQRLSDRLFRDVFWPSAEAVSPYCDGDHVFLLLYRELWYRHAHARLSPLTAAHRAESWTNYCDLFSVVLHGVVNMQLPNQWLWDMVDEFVYQFQSFCQYRAKLKTKTEDELNQLKQFDKAWNVYGVLNYLQALVEKSMITQILEKEKEGLEQFTATDGYDYEGGSNVLKVLGYYSMIGLLRIHCLLGDYHTGLKCLTPIDLNQQGVYTIVIGSHISAIYHYGFANLMMRRYVEATREFNKILLYILKYKQYHQNSPQYDQILKKNEQMYALLAICLSLCPQNKLIDENVSTQLKEKYNDKMTKMQRYDDEAYAAYDELFSYACPKFITPSPPILDQPLTNYNQDAYRLQLKLFLYEVKQQQLLSGIRSYLKLYSTITISKLAQYMEVDEATLRSILMTYKHKMHAVDSEGKIVSSADFDFYIVEDVIHVVESKPTKRHGDYFLRQILKFEEMIGELEKVQLD

SEQ ID NO: 1984 - protein, 521 aa, Zea mays
MAAAPYDREDGLQPSAPPHAVDAYDPSYVPDSVKTFVVHLYRHIRDKNVYEIHQMYEGGFQRLSDRLFRDAPWPSAEAVAPYCDGDPVFLLLYRELWYRHAHARLSPLTAAHRAESWTNYCDLFRVVLHGVVNMQLPNQWLWDMVDEFVYQFQSCCQYRAKLKTKTEDELNQLKQFDKAWNVYGVLNYLQALVEKSMITQILEREKEGLEQFTATDGYDYEGGSNVLKVLGYYSMIGLLRIHCLLGDYHTGLKCLGPIDLNQQGVYSIVIGSHISTIYHYGFANLMMRRYVEATREFNKILLYILKYKQYHQKSPQYDQILKKNEQMYALLVICLSLCPQNKLIDENVSTQLKEKYNDKMTKMQRYDDEAYAAYDELFSYACPKFITPSPPVLDQPLTNYNQDAYRLQLKLFLYEVKQQQLLSGIRSYLKLYSTITISKLAQYMEVDEATLRSILMTYKHKMHAVDSDGKMVSSADFDFYIVEDVIHVVESKPTKRHGDYFLRQILKFEEMIGGLDKVQLD

SEQ ID NO: 1985 - protein, 501 aa, Oryza sativa
MAAYDPSYVPDSVKTFVSHLYRHIRDRNVYETHQMYEGGFTRLSDRHFRDTPWPPAEAVAAHCDGDHVFLLLYRELWFRHAHARVQGLTPAQRAESWDNYCSLFSVVLQGVVNMQLPNQWLWDMVDEFVYQFQSFCQYRAKLKNKTHEEIALLKQYDQAWSVYGVLNYLKALVEKSMIGEILEREKVGLEQFTATDGYDYEGGSNVLKMLGYYSMIGLLRVHCLLGDYHTGLKCLAPIDISQQGVYTTVIGSHISTIYHYGFASLMMRRYIDGIREFNKILLYILKCKQYHQNSPQYDQLLKKNEQMYALLAICLSLCPQDKLIDENVGTQLKEKYGDKMTKMHRYDDEAYAIYDELFSYACPKFITASPPVLREPYTNYNQDAYRLQLKLFLYEVKQQQLLSGIRSYLKLYSTITIGKLAKYMDVDEVTLRTILMTYKHKMHSIDSDGKVISSADFDFYIDEDIIHVVESKLTKNHGDYFLRQILKFEEMITQLDKVQFD

SEQ ID NO: 1986 - protein, 521 aa, Sorghum bicolor
MAAAPYDREDGLPPSVPPHAADAYDPNYVPDSVKTFVVHLYRHIRDKNVYEIHQMYEGGFQRLSDRLFRDAPWPSAEAVAPYCDGDHVFLLLYRELWYRHAHARLSPLTAAHRAESWTNYCDLFSVVLHGVVNMQLPNQWLWDMVDEFVYQFQSFCQYRAKLKTKTEDELSQLKQFEKAWNVYGVLNYLKALVEKSMITQILEREKEGLEQFTATDGYDYEGGSNVLKVLGYYSMIGLLRIHCLLGDYHTGLKCLAPIDLNQQGVYTIVIGSHISTIYHYGFANLMMRRYVEATREFNKILLYILKYKQYHQKSPQYDQILKKNEQMYALLAICLSLCPQNKLIDENVSTQLKEKYNDKMTKMQRYDDEAYAAYDELFSYACPKFITPSPPVLDQPLTNYNQDAYRLQLKLFLYEVKQQQLLSGIRSYLKLYSTITISKLAQYMEMDEATLRSILMTYKHKMHAVDSDGKIVSSADFDFYIVEDVIHVVESKPTKRHGDYFLRQILKFEEMIGELEKVQLD

SEQ ID NO: 1987 - protein, 516 aa, Panicum virgatum
YDREDGLAPAPPPHAADAYDPNYVPDSVKTFVVHLYRHIRDKNVYEIHQMYEGGFQRLSDRLFRDAPWPSAEAVAPYCDGDHVFLLLYRELWYRHAHARLSPLTAAHRAESWANYCDLFSVVLHGVVNMQLPNQWLWDMVDEFVYQFQSFCQYRAKLKNKTEDELHQLKQFDKAWNVYGVLNYLQALVEKSMITQILEREKEGLEQFTATDGYDYEGGSNVLKVLGYYSMIGLLRIHCLLGDYHTGLKCLAPIDLNQQGVYTIVIGSHISTIYHYGFANLMMRRYVDATREFNKILLYILKYKQYHQKSPQYDQILKKNEQMYALLAICLSLCPQNKLIDENVSTQLKEKYNDKMTKMQRYDDEAYAAYDELFSYACPKFITPSPPVLDQPLTNYNQDAYRLQLKLFLYEVKQQQLLSGIRSYLKLYSTITIGKLAQYMEVDEATLRSILMTYKHKMHAVDSDGKIVSSADFDFYIVEDVIHVVESKPTKSHGDYFLRQILKFEEMIGELEKVQFD

SEQ ID NO: 1988 - protein, 522 aa, Triticum aestivum
MASAYDREDGLAPPQPHGGGPADAYDPNYVPDSVKTFVVHLYRHIRDKNVYEIHQMYEGGFQRLSDRLFRDTPWPSAEAVAPYCDGDHVFLLLYRELWYRHAYARLSPLTASHRSESWNNYCDLFSVVLHGVVNMQLPNQWLWDMVDEFVYQFQSFCQYRAKLKNKTEDELQQLKQFDKAWNVYGVLNYLQALVEKSMIAQILEREKEGLESFTATDGYDYQGGSNVLKVLGYYSMIGLLRIHCLLGDYHTGLKCLAPINLNQQGVYTIVIGSHISTIYHYGFANLMMRRYVDATKEFNKILLYIIKYKQYHQKSPQYDQILKKNEQMYALLAICLSLCPQNKLIDENVSAQLKEKYNDKMTKMQRFDDEAYAAYDELFSYACPKFITPSPPVLDQPLTNYNQDAYRLQLKLFLYEVKQQQLLSGIRSYLKLYSAITITKLAQYMEMDEATLRSILMTYKHKMHAVDSNGKIVSSADFDFYINEDVIHVVESKSTKRHGDYFLRQILKFEETIAELDKVQLD

SEQ ID NO: 1989 - protein, 254 aa, Hordeum vulgare
MGREDRFPLWEAALGAGVAAVFAAGLVGVYLSMPDSDYSFLKLPRNLHELQILTGHLENYTSDYTVQVLIGYCAVYIFMQTFMIPGTIFMSLLAGALFGQLRGVALVVFAASAGASSCYFLSKLIGKPLVFVLWPDKLTFFQKQVAKRREKLLNYMLFLRVTPTLPNTFINLASPIVDVPFHTFLLATLIGLIPAAYVTVRAGIALGELTSLSDLYDTQSVALLFLIGVVSVTPALLSKDEAQEKAPEIAAGAS

SEQ ID NO: 1990 - protein, 254 aa, Brachypodium distachyon
MGREDKFPVWEASLGAGVAAVFAAGLVGVYLSMPDSDYSFLKLPRNLEELQILTGHLENYTSDYTVQVLVGYCAVYIFMQTFMIPGTIFMSLLAGALFGQLRGVALVVFAASAGASSCYFLSKLIGKPLVFSLWPDKLTFFQKQVSKRREKLLNYILFLRVTPTLPNTFINLASPIVDVPYHTFLLGTLIGLIPAAYVTVRAGIALGELTSLSDLYDTQSMALLFLIGVVSVTPALLGKDEAPEKTPEIAVGTS

SEQ ID NO: 1991 - protein, 90 aa, Cenchrus ciliaris
MGKDERFPVWEAALGAGVAAAFAAGLVGVYLSMPDSDYSFLKLPRNLEELQILTGHLENYTSDYTLQVLVGYCAVYIFFLTPPPPGTIFM

SEQ ID NO: 1992 - protein, 238 aa, Festuca arundinacea
MGREDRFPVWEAALGAGVAAVFVAGLVGVYLSMPDSEYSFLKLPHNLQELQILTGHLENYTSDYTVQVLVGYCAVYIFMQTFMIPGTIFMSLLAGALFGQLWGVALVVFAASAGASSCYFLSKMIGKPLVFSLWPDKLTFFQKQVARRRQKLLNYMLFLRVTPTLPNTFINLASPIVDVPYHTFLLATLIGLIPAAYVTVRAGIALGELTSLSDLYDTQSVALLFLIGIVSVTPALLG

SEQ ID NO: 1993 - protein, 254 aa, Leymus cinereus x Leymus triticoides
MGREDRFPLWEAALGAGVAAVFAAGLVGVYLSMPDSDYSFLKLPRNLHELQILTVHLENYTSDYTVQVLIGYCAVYIFMQTFMIPGTIFMSLLAGALFGQLRGVALVVFAASAGASSCYFLSKLIGKPLVFVLWPDKLTFFQKQVAKRREKLLNYMLFLRVTPTLPNTFINLASPIVDVPYHTFLLATLIGLIPAAYVTVRAGIALGELTSLSDLYDTQSVALLFLIGVVSVTPALLSKDEAQEKAPEIAAGAS

SEQ ID NO: 1994 - protein, 254 aa, Zea mays
MGRDERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYMLFLRVTPTLPNTFINLASPIVDVPYHIFLLGTLIGLIPAAYVTVRAGIALGELTSLSDLYDTQSIALLFLIGVVSVTPALLGKDEAQEKPPEMAVGAS

SEQ ID NO: 1995 - protein, 254 aa, Zea mays
MGRDERFPVWEAALGAGVAAAFAAGLVGVYLSMPDSDYSFLKLPRNLQELQILTGHLENYTSDYTLQVLVGYCAVYIFMQTFMIPGTIFMSLLAGALFGQLRGVALVVFAATAGASSCYFLSKMIGKPLVFTLWPDKLSFFQRQVAKRREKLLNYMLFLRVTPTLPNTFINLASPIVDVPYHIFLLGTLIGLIPASYVTVRAGIALGELTSLSDLYDTQSIALLFLIGVVSVTPALLGKDEAQEKPSEMAVGAS

SEQ ID NO: 1996 - protein, 255 aa, Oryza sativa
MGREERFPVWEAALLAGVAAAFATGLVGVYLSMPHSDYSFLKLPKNLQELQILTDHLEDYTSDYTVQVLVGYCAVYIFMQTFMIPGTIFMSLLAGALFGQLGGVALVVFAATAGASSCYFLSKLIGKPLVFSLWPDKLGFFQKQVAKRREKLLNYMLFLRVTPTLPNTFINLASPIVDVPYHIFFLATFIGLIPAAYVTVRAGIALGDLSSLSDLYDKQSIALLFLIGVVSVTPTLLGKNEKQQGKGPEMVASSS

SEQ ID NO: 1997 - protein, 254 aa, Sorghum bicolor
MAREDGFPVWEAALLAAVAAVFAAGLAGVYVSMPRSDYSFLKLPRNLQELQVLTVHLEGYTSDYTIQVLVGYCAVYIFMQTFMIPGTIFMSLLAGALFGQLGGLALVIFAATAGASSCYFLSKLVGKPLVFSLWPDKLMFFQKQVAKRREKLLNYMLFLRVTPTLPNTFINFSSPIVGVPYHTFFLATAIGLIPAAYVTVRAGIALSDLRSLNDLYDPQSIAVLFLIGLVSVMPTLLGKNETPSRAPDMAASTN

SEQ ID NO: 1998 - protein, 254 aa, Sorghum bicolor
MGRDERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYILFLRVTPTLPNTFINLASPIVDVPYHTFLLGTLIGLIPAAYVTVRAGIALGELTSLSDLYDTQSIALLFLIGVVSVTPALLGKDEAQEKPSEMVVGAS

SEQ ID NO: 1999 - protein, 254 aa, Saccharum officinarum
MGRDERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYMLFLRVTPTLPNTFINLASPIVDVPYHTFLLGTLIGLIPAAYVTVRAGIALGELTSLSDLYDTQSIALLFLIGVVSVTPALLGKDEAQEKPSEMAVGAS

SEQ ID NO: 2000 - protein, 254 aa, Panicum virgatum
MGREERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGVALVVFAATAGASSCYFLSKMIGKPLVFSLWPDKLSFFQKQVAKRREKLLNYMLFLRVTPTLPNTFINLASPIVDVPYHTFLLGTLIGLIPAAYVTVRAGIALGELTSLSDLYDTQSIALLFLIGVVSVTPALLGKDEAQEKPSEMAVGAS

SEQ ID NO: 2001 - protein, 254 aa, Panicum virgatum
MGREERFPVWEAALGAGVAAAFAAGLAGVYLSMPDSDYSFLKLPRNLEELQILTGYLENYTSDYTLQVLVGYCAVYIFMQTFMIPGTIFMSLLAGALFGQLRGVALVVFAATAGASSCYFLSKMIGKPLVFSLWPDKLSFFQKQVAKRREKLLNYMLFLRVTPTLPNTFINLASPIVDVPYHTFLLGTLIGLIPAAYVTVRAGIALGELTSLSDLYDTQSIALLFLIGVVSVTPALLGKDEAQEKPSEMAVGAS

SEQ ID NO: 2002 - protein, 254 aa, Triticum aestivum
MGREDRFPVWEAALGAGVAAVFAAGLVGVYLSMPDSDYSFLKLPRNLHELQILTGHLENYTSDYTVQVLIGYCAVYIFMQTFMIPGTIFMSLLAGALFGQLRGVALVVFAASAGASSCFFLSKMIGKPLVFVLWPDKLTFFQKQVAKRREKLLNYMLFLRVTPTLPNTFINLASPIVDVPFHTFLLATLIGLIPAAYVTVRAGIALGELTSLSDLYDTQSVALLFLIGVVSVTPALLSKDEAQDTAPEIAAGAS

SEQ ID NO: 2003 - protein, 254 aa, Triticum aestivum
MGREDRFPVWEAALGAGVAAVFAAGLVGVYLSMPDSDYSFLKLPRNLHELQILTGHLENYTSDYTVQVLIGYCAVYIFMQTFMIPGTIFMSLLAGALFGQLRGVALVVFAASAGASSCFFLSKLIGKPLVFVLWPDKLTFFQKQVAKRREKLLNYMLFLRVTPTLPNTFINLASPIVDVPFHTFLLATLIGLIPAAYVTVRAGIALGELTSLSDLYDTQSVALLFLIGVVSVTPALLSKDEAQEKAPEVAAGAS

SEQ ID NO: 2004 - protein, 254 aa, Triticum aestivum
MGREDRFPVWEAALGAGVAAVFAAGLVGVYLSMPDSDYSFLKLPRNLHELQILTGHLENYTSDYTVQVLIGYCAVYIFMQTFMIPGTIFMSLLAGALFGQLRGVALVVFAASAGASSCFFLSKLIGKPLVFVLWPDKLTFFQKQVAKRREKLLNYMLFLRVTPTLPNTFINLASPIVDVPFHTFLLATLIGLIPAAYVTVRAGIALGELTSLSDLYDTQSVALLFLIGVVSVTPALLSKDEAQDTAPEIAAGAS

SEQ ID NO: 2005 - protein, 69 aa, Brassica oleracea
MADEEVVDPKKYLEESCKPKCVKPLLEYQACVKRIQGDDSGHKHCTGQYFDYWHCIDKCVAPKLFAKLK

SEQ ID NO: 2006 - protein, 69 aa, Hordeum vulgare
MADNEPVDPKNFLEERCKPQCVKSLYDYERCVKRVENDETGQKHCTGQFFDYWSCVDKCVAPKLFEKLK

SEQ ID NO: 2007 - protein, 69 aa, Hordeum vulgare
MADEEPVDPKKYLEERCKPQCVKPLYEYEKCIKRVEADDTGHKHCTGQYFDYWSCIDKCVAPKLFEKLK

SEQ ID NO: 2008 - protein, 69 aa, Brachypodium distachyon
MADEEPVDPKKYLEERCKPQCVKPLYEYERCVKRVESDDTGHKHCTGQYFDYLSCIDKCVAPKLFEKLK

SEQ ID NO: 2009 - protein, 69 aa, Brachypodium distachyon
MADDEPVDQKNYLEERCKPQCVKPLYEYERCVKRVENDESGQKHCTGQFFDYWSCVDKCVAPKLFEQLK

SEQ ID NO: 2010 - protein, 69 aa, Bruguiera gymnorhiza
MADEEPVDPKKYLEEACKPKCVKPLLEYQACAKRIQGDETGYKHCTGQYFDYWACIDKCVAPKLFEKLK

SEQ ID NO: 2011 - protein, 69 aa, Brassica napus; identical to SEQ ID NO: 2005

SEQ ID NO: 2012 - protein, 69 aa, Brassica napus; identical to SEQ ID NO: 2005

SEQ ID NO: 2013 - protein, 68 aa, Manihot esculenta
ADEEPVDQKKYLEESCKPKCVKPLLEYEACVKRIKDDDSGHKHCTGQYFDYWSCIDKCVAPKLFSKLK

SEQ ID NO: 2014 - protein, 69 aa, Ricinus communis
MADEEPVDQKKYLEESCKPKCVKPLLEYEACVKRIRGDETGHKHCTGQYFDYWSCVDKCVAPKLFSKLK

SEQ ID NO: 2015 - protein, 69 aa, cucumber
MADEEPVDQKRYLEEACKPKCVKPLLEYQACVKRIQGDDSGHKHCTGQYFDYWSCIDKCVAPKLLTKLK

SEQ ID NO: 2016 - protein, 69 aa, Eucalyptus gunnii
MADEEPVDQKKYLEELCKPKCVKPLLEYKACVKRIEGDESGHKHCTGQYFDYWHCIDKCVALKLFEKLK

SEQ ID NO: 2017 - protein, 69 aa, Actinidia deliciosa
MADEEPVDPKKYLEESCKPKCVKPLLEYQACVKRIHGDETGHKHCTGQYFDYWACVDKCVAPKLFPKLK

SEQ ID NO: 2018 - protein, 69 aa, Actinidia deliciosa
MADEEPVDPKKYLEESCKPKCVKPLLEYQACVKRIQSDETGHKHCTGQYFDYWACIDKCVAPKLFSKLK

SEQ ID NO: 2019 - protein, 69 aa, Liriodendron tulipifera
MADEEPVDQKKYLEESCKPKCVKPLLEYRACVKRIEGDETGHKHCTGQYFDYWSCVDKCVAPKLFTKLK

SEQ ID NO: 2020 - protein, 69 aa, Zea mays
MADAEPVDQKNYLEERCKPQCVKTLYDYEKCVKRVESDGSGQKHCTGQYFDYWSCVDKCVAPKLFDKLK

SEQ ID NO: 2021 - protein, 69 aa, Zea mays
MEDEELVDQKKYLEERCKPQCVKSLYEYEKCVKRVENDDTGHKHCTGQYFDYWSCIDKCVASKLFKKLK

SEQ ID NO: 2022 - protein, 121 aa, Zea mays
MFLHIAACNVPQGNSSDQQVQHPPWIRDCKGEIPTGVSLFLGRFVFFNFQRENVAKQVPEQNGKTHFDAGDERAKEFSALLKSNDPVGFNLVDVLAWGSLGHIVAYYILATSSNGYDPNFF

SEQ ID NO: 2023 - protein, 81 aa, Zea mays
YSRSIVGASLEVIQKKRAEKPEVRDAAREAALREIKERIKKTKDEKKAKKAEVSKSQKAQTKGAVQKGSKGPKLGGGGGKR

SEQ ID NO: 2024 - protein, 69 aa, Pennisetum glaucum
MEDEELVDQKKYLEERCKPQCVKSLYEYEKCVKRVENDDTGHKHCTGQYFDYWSCIDKCVAPKLLKKLK

SEQ ID NO: 2025 - protein, 69 aa, Pennisetum glaucum
MADTEPVDPKNYLEERCKPQCVKSLYDYERCMKRVENDGSGQKHCTGQYFDYWSCVDKCVAPKLFDKLK

SEQ ID NO: 2026 - protein, 69 aa, Avena sativa
MADEEPVDPKKYLEERCKPQCVKPLYVYEKCVKRVEADDTGHKHCTGQYFDYLSCVDKCVASKLFQQLK

SEQ ID NO: 2027 - protein, 68 aa, Avena sativa
MADEPVDPKNHLEQRCKPQCVKSLYDYEKCVKRVESDETGHKHCTGQYFDYLSCVDKCVAPKLFEQLK

SEQ ID NO: 2028 - protein, 69 aa, Populus trichocarpa
MADEELVDQKKYLEDSCKPKCVKPLLEYEACVKRVEGDDSSQKHCTGQYFDYWFCIDKCVAPKLLSKLK

SEQ ID NO: 2029 - protein, 69 aa, Populus trichocarpa
MADEEPVDPKKYLEESCKPKCVKPLLEYQACVKRIQGDETGHKHCTGQYFDYWSCVDKCVALKLFSKLK

SEQ ID NO: 2030 - protein, 69 aa, Secale cereale
MADEEPVDPKKYLEERCKPQCVKPLYEYEKCIKRVEADDTGHKHCTGQYFDYLSCIDKCVAPKLFEKLK

SEQ ID NO: 2031 - protein, 69 aa, Secale cereale
MADNEPIDPKNYLEERCKPQCVKSLYDYERCVKRVENDEIGQKHCTGQFFDYWSCVDKCVAPKLFEKLK

SEQ ID NO: 2032 - protein, 69 aa, Sorghum bicolor
MEDEELVDQKKYLEERCKPQCVKSLYEYEKCVKRVESDETGHKHCTGQYFDYWSCIDKCVAPKLFKKLK

SEQ ID NO: 2033 - protein, 69 aa, Saccharum officinarum
  misc_feature (2)..(2): Xaa can be any naturally occurring amino acid
MXDEELVDQKKYLEERCKPQCVKSLYEYEKCVKRVESDDTGHKHCTGQYFDYWSCIDKCVAPKLFKKLK

SEQ ID NO: 2034 - protein, 69 aa, Saccharum officinarum
MADAEPVDQKNYLEERCKPQCVKSLYDYERCVKRVENDGSGQKHCTGQYFDYWSCVDKCVAPKLFDKLK

SEQ ID NO: 2035 - protein, 69 aa, Panicum virgatum
MADAEPVDPKNYLEERCKPQCVKSLYDYERCMKRVENDDSGQKHCTGQYFDYWSCVDKCVAPKLFDKLK

SEQ ID NO: 2036 - protein, 69 aa, Panicum virgatum
MADAEPVDPKNYLEERCKPQCVKSLYDYERCMKRVENDDSGHKHCTGQYFDYWSCVDKCVAPKLFDKLK

SEQ ID NO: 2037 - protein, 75 aa, Panicum virgatum
MSEESSRDDEELVDQKKYLEERCKPQCVKSLYEYDKCVKRVENDDTGHKHCTGQYFDYWSCIDKCVAPKLFKKLK

SEQ ID NO: 2038 - protein, 69 aa, Panicum virgatum
MDDEELVDQKKYLEERCKPQCVKSLYEYDKCVKRVENDDTGHKHCTGQYFDYWSCIDKCVAPKLFKKLK

SEQ ID NO: 2039 - protein, 69 aa, Panicum virgatum; identical to SEQ ID NO: 2038

SEQ ID NO: 2040 - protein, 69 aa, Triticum aestivum
MADNEPIDPKNYLEERCKPQCVKSLYDYERCVKRVKNDETGQKHCTGQFFDYWSCVDKCVAPKLFEKLK

SEQ ID NO: 2041 - protein, 69 aa, Triticum aestivum
MADNEPVDPKNYLEERCKPQCVKSLYDYERCVKRVENDETGQKHCTGQFFDYWSCVDKCVAPKLFEKLK

SEQ ID NO: 2042 - protein, 69 aa, Triticum aestivum
MANEEPVDPKKYLEERCKPQCVKPLYEYEKCIKRVEADDTGHKHCTGQYFDYWSCIDKCVAPKLFEKLK

SEQ ID NO: 2043 - protein, 69 aa, Triticum aestivum; identical to SEQ ID NO: 2007

SEQ ID NO: 2044 - protein, 69 aa, Triticum aestivum
MADNEPIDPKNYLEERCKPQCVKSLYDYERCVKRVENDETGQKHCTGQFFDYWSCVDKCVAPKLFEKLK

SEQ ID NO: 2045 - protein, 69 aa, Triticum aestivum; identical to SEQ ID NO: 2007

SEQ ID NO: 2046 - protein, 1082 aa, arabidopsis lyrata
MAAEKLRDLSQPIDVVLLDAIVEAFYATGSKEERASADTILRDLKANPDTWLQVVHILQNTSSTHTKYFALQVLEGVIKYRWNALPVEQRDGMKNYISDIIVQLSRDEASFRTERLYVNKLNVILVQIVKHEWPAKWKSFIPDLVIAAKTSETICENCMAILKLLSEEVFDFSRGEMTQQKIKELKQSLNRQFQLIHELCLYVLSASQRQELIRATLSALHAYLSWIPLGYIFESPLLETLLKFFPVPAFRNLTLQCLSEVASLNFGDFYNVQYVKMYSIFMNQLQAILPINLNIPEAYSTGSSEEQASYFFSAFIQNLALFFTSFFKLHIKILESAPENISLLLAGLGYLISISYVDDTEVFKVCLDYWNSLVLELFGAQHHAGHPALTPTLFGLQMSFLPITVDGVKPEVTERHQLYSDPMSKLRGLMISRMAKPEEVLIVEDENGNIVRETMKDNDVLVQYKIMRETLIYLSHLDHEDTEKQMLSKLSKQLSGEEWAWNNLNTLCWAIGSISGSMVVEQENRFLVLVIRDLLSLCEVVKGKDNKAVIASNIMYVVGQYSRFLRAHWKFLKTVVHKLFEFMHETHPGVQDMACDTFLKIVQKCKRKFVIVQVGESEPFVSELLSGLATIVGDLQPHQIHTFYESVGSMIQAESDPQKRGEYLQRLMALPNQKWAEIIGQARQSADILKDPDVIRTVLNILQTNTRVATSLGTFFLSQISLIFLDMLNVYRMYSELVSSSIANGGPYASRTSLVKLLRSVKREILKLIETFLDKAENQPHIGKQFVPPMMDQVLGDYARNVPDARESEVLSLFATIINKYKVVMRDEVPLIFEAVFQCTLEMITKNFEDYPEHRLKFFSLLRAIATFCFRALIQLSSEQLKLVMDSVIWAFRHTERNIAETGLNLLLEMLKNFQKSDFCNKFYQAYFLQIEQEVFAVLTDTFHKPGFKLHVLVLQHLFSLVESGSLTEPLWDAATVTHPYPNNVAFVLEYTTKLLSSSFPNMTTTEVTQFVNGLYESRNDAGRFKNNIRDFLVQSKEFSAQDNKDLYAEEAAAQMERERQRMLSIPGLIAPSEIQDDMADS

SEQ ID NO: 2047 - protein, 1076 aa, arabidopsis lyrata
MAAEKLRDLSQPIDVGVLDATVAAFFVTGSKEERAAADQILRDLQANPDMWLQVVHILQNTKSMDTKFFALQVLEGVIKYRWNALPVEQRDGMKNYISEVIVQLSSNEASFRSERLYVNKLNVILVQIVKHDWPAKWTSFIPDLVAAAKTSETICENCMAILKLLSEEVFDFSRGEMTLQKIKELKQSLNSEFKLIHELCLYVLSASQRQDLIRATLSALHAYLSWIPLGYIFESPLLETLLKFFPVPAYRNLTLQCLTEVAALNFGDFYNVQYVNMYTIFIGQLRAILPPSTNIPEAYSSGSGEEQAFIQNLALFFTSFFKFHIRVLESAPEVVALLLAGLEYLINISYVDDTEVFKVCLDYWNSLVLELFDAHHNSDNPAVSASLMGLQMPFLPGMVDGLGSQVMQRRQLYSNPMSKLRGLMINRMAKPEEVLIVEDENGNIVRETMKDNDVLVQYKIMRETLIYLSHLDHDDTEKQMLRKLNKQLSGEEWAWNNLNTLCWAIGSISGSMAEDQENRFLVMVIRDLLNLCEITKGKDNKAVIASNIMYVVGQYPRFLRAHWKFLKTVVNKLFEFMHETHPGVQDMACDTFLKIVQKCKRKFVIVQVGENEPFVSELLSGLATTVQDLEPHQIHSFYESVGNMIQAEPDPQKRDEYLQRLMALPNQKWAEIIGQARQSVEFLKDPGVIRTVLNILQTNTSAATSLGTYFLSQISLIFLDMLNVYRMYSELVSTNITEGGPYASKTSFVKLLRSVKRETLKLIETFLDKAEDQPHIGKQFVPPMMESVLGDYARNVPDARESEVLSLFATIINKYKATMLEDVPHIFEAVFQCTLEMITKNFEDYPEHRLKFFSLLRAIATFCFPALIKLSSPQLKLVMDSIIWAFRHTERNIAETGLNLLLEMLKNFQQSEFCNQFYRTYFMQIEQEIFAVLTDTFHKPGFKLHVLVLQQLFCLPESGALTEPLWDATTVPYPYPNNAAFVREYTIKLLSSSFPNMTAAEVTQFVDGLYESRNDPSGFKNNIRDFLVQSKEFSAQDNKDLYAEEAAAQRERERQRMLSIPGLIAPNEIQDEMVDS

SEQ ID NO: 2048 - protein, 1076 aa, Arabidopsis thaliana
MAAEKLRDLSQPIDVVLLDATVEAFYSTGSKEERASADNILRDLKANPDTWLQVVHILQNTSSTHTKFFALQVLEGVIKYRWNALPVEQRDGMKNYISDVIVQLSRDEASFRTERLYVNKLNIILVQIVKQEWPAKWKSFIPDLVIAAKTSETICENCMAILKLLSEEVFDFSKGEMTQQKIKELKQSLNSEFQLIHELCLYVLSASQRQELIRATLSALHAYLSWIPLGYIFESPLLEILLKFFPVPAYRNLTLQCLSEVASLNFGDFYDMQYVKMYSIFMNQLQAILPLNLNIPEAYSTGSSEEQAFIQNLALFFTSFFKLHIKILESAPENISLLLAGLGYLISISYVDDTEVFKVCLDYWNSLVLELFGTRHHACHPALTPSLFGLQMAFLPSTVDGVKSEVTERQKLYSDPMSKLRGLMISRTAKPEEVLIVEDENGNIVRETMKDNDVLVQYKIMRETLIYLSHLDHEDTEKQMLSKLSKQLSGEEWAWNNLNTLCWAIGSISGSMVVEQENRFLVMVIRDLLSLCEVVKGKDNKAVIASNIMYVVGQYSRFLRAHWKFLKTVVHKLFEFMHETHPGVQDMACDTFLKIVQKCKRKFVIVQVGESEPFVSELLSGLATIVGDLQPHQIHTFYESVGSMIQAESDPQKRGEYLQRLMALPNQKWAEIIGQARQSADILKEPDVIRTVLNILQTNTRVATSLGTFFLSQISLIFLDMLNVYRMYSELVSSSIANGGPYASRTSLVKLLRSVKREILKLIETFLDKAENQPHIGKQFVPPMMDQVLGDYARNVPDARESEVLSLFATIINKYKVVMRDEVPLIFEAVFQCTLEMITKNFEDYPEHRLKFFSLLRAIATFCFRALIQLSSEQLKLVMDSVIWAFRHTERNIAETGLNLLLEMLKNFQKSDFCNKFYQTYFLQIEQEVFAVLTDTFHKPGFKLHVLVLQHLFSLVESGSLAEPLWDAATVPHPYSNNVAFVLEYTTKLLSSSFPNMTTTEVTQFVNGLYESRNDVGRFKDNIRDFLIQSKEFSAQDNKDLYAEEAAAQMERERQRMLSIPGLIAPSEIQDDMADS

SEQ ID NO: 2049 - protein, 1075 aa, Arabidopsis thaliana
MAAEKLRDLSQPIDVGVLDATVAAFFVTGSKEERAAADQILRDLQANPDMWLQVVHILQNTNSLDTKFFALQVLEGVIKYRWNALPVEQRDGMKNYISEVIVQLSSNEASFRSERLYVNKLNVILVQIVKHDWPAKWTSFIPDLVAAAKTSETICENCMAILKLLSEEVFDFSRGEMTQQKIKELKQSLNSEFKLIHELCLYVLSASQRQDLIRATLSALHAYLSWIPLGYIFESTLLETLLKFFPVPAYRNLTIQCLTEVAALNFGDFYNVQYVKMYTIFIGQLRIILPPSTKIPEAYSSGSGEEQAFIQNLALFFTSFFKFHIRVLESTPEVVSLLLAGLEYLINISYVDDTEVFKVCLDYWNSLVLELFDAHHNSDNPAVSASLMGLQPFLPGMVDGLGSQVMQRRQLYSHPMSKLRGLMINRMAKPEEVLIVEDENGNIVRETMKDNDVLVQYKIMRETLIYLSHLDHDDTEKQMLRKLNKQLSGEEWAWNNLNTLCWAIGSISGSMAEDQENRFLVMVIRDLLNLCEITKGKDNKAVIASNIMYVVGQYPRFLRAHWKFLKTVVNKLFEFMHETHPGVQDMACDTFLKIVQKCKRKFVIVQVGENEPFVSELLTGLATTVQDLEPHQIHSFYESVGNMIQAESDPQKRDEYLQRLMALPNQKWAEIIGQARHSVEFLKDQVVIRTVLNILQTNTSAATSLGTYFLSQISLIFLDMLNVYRMYSELVSTNITEGGPYASKTSFVKLLRSVKRETLKLIETFLDKAEDQPHIGKQFVPPMMESVLGDYARNVPDARESEVLSLFATIINKYKATMLDDVPHIFEAVFQCTLEMITKNFEDYPEHRLKFFSLLRAIATFCFPALIKLSSPQLKLVMDSIIWAFRHTERNIAETGLNLLLEMLKNFQQSEFCNQFYRSYFMQIEQEIFAVLTDTFHKPGFKLHVLVLQQLFCLPESGALTEPLWDATTVPYPYPDNVAFVREYTIKLLSSSFPNMTAAEVTQFVNGLYESRNDPSGFKNNIRDFLVQSKEFSAQDNKDLYAEEAAAQRERERQRMLSIPGLIAPNEIQDEMVDS

SEQ ID NO: 2050 - protein, 1074 aa, Brachypodium distachyon
MADKLRDLSQPIDVPVLDATVAAFYGTGSKEERNAADQILRELQNNPDMWLQVVHILQNSQNLNTKFFALQVLESVIKYRWNALPTEQRDGMKNYVSDVIVQLSSNEASFRQERLYVNKLNIILVQVLKHEWPARWSSFIPDLVAAAKSSETICENCMAILKLLSEEIFDFSRGEMTQLKIKELKSSLNSEFRLVHELCLYVLSATQSSELIRATLATLHAFLSWIPVGFIFESPLLETLLKFFPMAAYRNLTLQCLTEVAALQFGDFYDMQYVKMYTIFMMQLQAILPPGPATIPDAYANGSNEEQAFIQNLALFFTAFFKNHMRILEASPENRAALLLGLEYLIGISYVDDTEVFKVCLDYWNVFVLELFEAHNQMEPATAAVSMMGLQAQMIPGVIDGTVTAVQQRRQLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSNLTTTILDLEPHQIHTFYESVGHMIQAESDNTKRDEYLKRLMSLPNLKWAEIIGQAGQSIDILKNQDVIRSVLNILQTNTSVANSLGPHFFPQISLIFLDMLTVYRMYSELVSSTIAEGGPYASKSSFVKLLRSIKRETLKLIETFVDKAEDLPHLGKQFVPPMMDPVLGDYARNVPDARESEVLSLFATIINKYKGEMLDDVPRIFEAVFQCTLEMITKNFEDYPEHRLKFFSLLRAIGTHCFQALIQLSSQQLKLVIDSINWAFRHTERNIAETGLSLLLEILKNFQASAFQNQFYKTYFLNIEQEIFAVLTDSFHKPGFKLHVLVLQHLFCVVDGLTEPLWDASSVPYQYTDNAMFVRDYTVKLLGASFPNIAPAEVTKFVDGLLSSKHDLPSFKNHIRDFLVQSKEFSVQDNKDLYAEEAAVQRERERQRMLAIPGLIAPSELQDEMLDS

SEQ ID NO: 2051 - protein, 1064 aa, Ricinus communis
MAAEKLRDLSQPIDVPLLDATVAAFYGTGSKEERAAADRILQELQSNPDMWMQVVHILQNTKNLNTKFFALQVLEGVIKYRWNALPVQQRDGMKNYISEVIVQLSSNEASFRLERLYVNKLNIILVQILKHEWPARWRSFIPDLVAAAKTSETICENCMAILKLLSEEVFDFSRGEMTQQKIKELKQSLNSEFQLIHELCLYVLSASQRTELIRATLSTLHAFLSWIPLGYIFESPLLETLLKFFPMPSYRNLTLQCLTEVAALNFGDFYNMQYVKMYTFFMVQLQAILPPTTNIPEAYAHGSSEEQAFIQNLSLFFTSFYKSHIRVLETTQENISALLMGLEYLINISYVDDTEVFKVCLDYWNSLVLELFEAHHNLDNPAVTANMMGLQMPLLHGMVDGIGSQILQRRQLYTGPMSKLRMLMICRMAKPEEVLIVEDENGNIVRETMKDNDVLVQYKIMRETLIYLSHLDHEDTEKQMLKKLSKQLSGEDWSWNNLSTLCWAIGSISGSMMEEQENRFLVMVIRDLLNLCEITKGKDNKAVIASNIMYVVGQYPRFLRAHWKFLKTVVNKLFEFMHETHPGVQDMACETFLKIVTKCKRKFVILQVGESEPFVSELLIGLPTTVADLEPHQIHSFYESVGHMIQAEPDPQKRDEYLQRLMDLPNQKWAEIIGQARQSVDFLKDQEVIRTVLNILQTNTSVASSLGTYFLTQISLIFLDMLNVYRMYSELISSSIADGGPSVKRETLKLIETFLDKAEDQPQIGKQFVPPMMDPVLGDYARNLPDARESEVLSLFAIIINKYKAAMIDDVPRIFEAVFQCTLEMITKNFEDYPEHRLKFFSLLRAIATHCFPALIRLSSQQLKLVMDSIIWAFRHTERNIAETGLNLLLEMLKNFQASEFCNQFYRTYFVTIEQEIFAVLTDTFHKPGFKLHVLVLQHLFCLVESGALTEPLWDAATVPLPYPNNAMFVREYTIKLLGTSFPNMTASEVTQFVNGLFESRNDLSVFKNHIRDFLVQSKEFSAQDNKDLYAEEAAAQRERERQRMLSIPGLIAPNEIQDEMLDS

SEQ ID NO: 2052 - protein, 1077 aa, Castanea mollissima
MAAEKLRDLSQPIDVALLDATVAAFYGTGSKEERTAADQILRDLQNNPDMWLQVMHILQNTKNLNTKFFALQVLEGVIKYRWNALPVEQRDGMKNYISDVIVQLSSNEASFRIERLYVNKLNVILVQILKHEWPVRWRSFIPDLVAAAKTSETICENCMAILKLLSEEVFDFSRGEMTQQKIKDLKQSLNSEFQLIHELCLYVLSASQRTELIRATLSTLHAFLSWIPLGYIFESPLLETLLKFFPVPAYRNLTLQCLTEVAALNFGDFYNVQYVKMYSIFMVQLQVILPPTTNIPEAYAHGSSEEQAFIQNLALFFTSFYKFHIRVLEVTQENINALLMGLEYLTNISYVDDTEVFKVCLDYWNSLVLELFEAHHNIDNPAVAAANMMGLQMPMLPGIVDGIGSQILQRRQLFAIPMSKLRMLMICRMAKPEEVLIVEDENGNIVRETMKDNDVLVQYKIMRETLIYLSHLDHEDTEKQMLKKLSKQLSGEDWTWNNLNTLCWAIGSISGSMMEEQENRFLVMVIRDLLNLCEITKGKDNKAVIASNIMYVVGQYPRFLRAHWKFLKTVVNKLFEFMHETHPGVQDMACDTFLKIVQKCKRKFVIVQVGENEPFVSELLTGLPTTIADLEPHQIHTFYESVGHMIQAESDPQKRDEYLQRLMELPNQKWVEIIGKARQSVDFLKDQDVIRTVLNILQTNTSVANSLGTYFLSQISLIFLDMLNVYRMYSELISSSIAEGGPFASKTSYVKLLRSVKRETLKLIETFLDKAEDQPQIGKQFVPPMMDPVLGDYARNLPDARESEVLSLFATIINKYKAAMIEDVPRIFEAVFQCTLEMITKNFEDYPEHRLKFFSLLRAIATHCFPALIRLSSQQLKLVMDSIIWAFRHTERNIAETGLNLLLEMLKNFQNSEFCNQFYQSYFLQIEQEIFAVLTDTFHKPGFKLHVLVLQHLFCLVESGGLTEPLWDVATVPYPYPNNTMFVREYTIKLLSTSFPNMTAAEVTQFVNGLFESRNELSAFKNHIRDFLVQSKEFSAQDNKDLYAEEAAAQRERERQRMLSIPGLIAPNEIQDEMLDS

SEQ ID NO: 2053 - protein, 1076 aa, cucumber
MAAEKLRDLSQPIDVTLLDATVAAFYGTGSKEERSAADQILRDLQNNADMWLQVVHILQNTKNLNTKFFALQVLEGVIKYRWNALPVEQRDGMKNYISDVIVQLSSNEASFRVERLYVNKLNIILVQILKHEWPAKWRSFIPDLVSAARTSETICENCMAILKLLSEEVFDFSRGEMTQQKIKELKQSLNSEFQLIHELCLFVLSVSQRTELIRATLSTLHAFLSWIPLGYIFESPLLETLLKFFPVPSYRNLTLQCLTEVAALNFGDYYNRQYIEMYTVFMGRLQTILPPSTNIPEAYAHGSSEEQAFIQNLALFFTSFYKSHIRVLESTQESIAALLMGLEYLINISYVDDNEVFKVCLDYWNSLVLELFETHHNMDNPAVSANMMGLQVPLLSGVVDGLGAQLMQRRQLYSGPMSKLRMLMICRMAKPEEVLIVEDENGNIVRETMKDNDVLVQYKSMRETLIYLSHLDHDDTEKQMLKKLSRQLSGEDWSWNNLNTLCWAIGSISGSMMEDQENRFLVMVIRDLLNLCEITKGKDNKAVIASNIMYVVGQYPRFLRAHWKFLKTVVNKLFEFMHETHPGVQDMACDTFLKIVQKCKRKFVIVQVGESEPFVSELLTSLPTTVADLEPHQIHTFYESVGNMIQAEPDPQKRDEYLQRLMDLPNQKWAEIIGQARQSVEFLKDQDVIRTVLNILQTNTSVASSLGTYFLPQISLIFLDMLNVYRMYSELISSSIAGGGPYTSKTSYVKLLRSVKRETLKLIETFLDKAEDQPQIGKQFVPPMMEPVLLDYARNLPDARESEVLSLFATIINKYKNTMIEDVPCIFEAVFQCTLEMITKNFEDYPEHRLKFFSLLRAIATYCFPALIRLSSQHLKLVMDSIIWAFRHTERNIAETGLNLLLEMLKNFQASEFCNQFYRTYFLTIEQEIFAVLTDTFHKPGFKLHVLVLQHLFCLAESGVLTEPLWDAATVTYPYPNNVAFVREYTIKLLSSSFPNMTAAEVTQFVNGLFDSRNDLSVFKNHIRDFLVQSKEFSAQDNKDLYAEEAAAQRERERQRMLTIPGLIAPNEIQDEMVDS

SEQ ID NO: 2054 - protein, 1078 aa, Lotus japonicus
MAAEKLRDLSQPIDVPLLDATVAAFYGTGSKEQRTAADQILRDLQNNPDMWLQVMHILQNTQNLNTKFFALQVLEGVIKYRWNALPLEQRDGMKNFISDIIVQLSGNEASFRMERLYVNKLNIILVQILKHEWPLRWRSFIPDLVSAAKTSETICENCMAILKLLSEEVFDFSRGEMTQQKIKELKQSLNSEFQLIHELCLYVLSASQRAELIRATLSTLHAFLSWIPLGYIFESPLLETLLKFFPLPVYRNLTLKCLIEVAALQFGDYYDTQYTKMYNIFMVQLQTILLPTTNIPEAYAQGSSEEQTFIQNLALFFTSFYKVHIRILESTQENIAALLSGLEYLINISYVDDTEVFKVCLDYWNILVSELFEPHRSLENPAAAATNMLGNQAPLMPPGMVDGLGSQLLQRRQLYAGPMSKLRTLMICRMAKPEEVLIIEDENGNIVRETLKDNDVLVQYKIMRETLIYLSHLDHDDTERQMLRKLSKQLGGEDWTWNNLNTLCWAIGSISGSMMEDQENRFLVMVIRDLLNLCEFTKGKDNKAVIASNIMYVVGQYPRFLRAHWKFLKTVVNKLFEFMHESHPGVQDMACDTFLKIVQKCKRKFVITQLGENEPFVSELLSGLSTTIVDLEPHQIHTFYESVGSMVQAESDSQKRDEYLQRLMHLPNQKWLEIIGQARQNVDFLKDHDVIRTVLNILQTNTSVASSLGTYFLPQISLIFLDMLNVYRMYSELISKSIAEGGPYASRTSFVKLLRSVKRETLKLIETFLDKAEDQPQIGKQFVPPMMDPVLGDYARNVPDARESEVLSLFATIVNKYKAAMVEDVPRIFEAVFQCTLEMITKNFEDYPEHRLKFFSLLCAIATHCFHALICLSSQQLKFVMDSIIWAFRHTERNIAETGLNLLLEMLKKFQATEFCNQFYRTYFLTIEQEIFAVLTDTFHKPGFKLHVLVLQHLFCLAETGALTEPLWDAATNPYPYPSNAAFVLEYTIKLLSTSFPNMTAAEVTQFVNGLFESTNDLSTFKNHIRDFLVQSKEFSAQDNKDLYAEEAAAQRERERQRMLSVPGLIAPSELQDEMLDS

SEQ ID NO: 2055 - protein, 1077 aa, Lotus japonicus
MAAEKLRDLTQPMDVPLLDATVSAFYGTGSKEERSAADQILRELQNNPDMWLQVMHILQNTQSLNTKFFALQVLEGVIKYRWNALPAEQRDGMKNFISDVIVQLSSNEASFRMEKLYVNKLNIILVQILKHEWPARWRSFIPDLVSAAKTNETICENCMAILKLLSEEVFDFSRGEMTQQKIKELKQSLNSEFQLIHELCLYVLSASQRTELMRATLSTLHAFLSWIPLGYIFESPLLETLLKFFPVPAYRNLTLQCLTEVAGLQFGNYYDVQYVKMYNIFMVQLQGVLPPTTNIPEAYAHGSSEEQAFIQNLALFFTSFYKVHIRILESTQENISALLLGLEYLINISYVDDTEVFKVCLDYWNSLVSELYEPNRSLDNPASAATMMGLQVPGMLPGMVDGHGSQHLQRRQLYAGPMSKLRMLMISRMAKPEEVLIVEDENGNIVRETLKDNDVLVQYKIMRETLIYLSHLDHDDTEKQMLRKLNKQLSGEDWTWNNLNTLCWAIGSISGSMMEEQENRFLVMVIRDLLNLCEITKGKDNKAVIASNIMYVVGQYPRFLRAHWKFLKTVVNKLFEFMHEIHPGVQDMACDTFLKIVQKCKRKFVITQLGENEPFVSELLSGLPITIADLEPHQIHSFYESVAHMIQAESDAQKRDEYLQRLMQLPNQKWMEIIGQAHQNVEFLKDQDVIRTVLNILQTNTSVASSLGTYFLPQITLIFLDMLNVYRMYSELISKSISEGGPFTSRTSYVKLLRSVKRETLKLIETFLDKAEDQPQIGKQFVPPMMDPVLGDYARNVPDARESEVLSLFATIVNKYKAAMIEDVPRIFEAVFQCTLEMITKIFEDYPEHRLKFFSLLRAIATHCFPALICLSSQQLKLVMDSIIWAFRHTERNIAETGLNLLLEMLKKFQGSEFCNQFYRTYFLTIEQEIFAVLTDTFHKPGFKLHVLVLQHLFCLLETGALTEPLWDAATNPYPYPSNAAFVREFTIKLLSTSFPNMTTAEVTQFVNGLFESTTDLSTFKTHIRDFLIQSKEFSAQDNKDLYAEEAAAQRERERQRMLAIPGLIAPNELQDEMVDS

SEQ ID NO: 2056 - protein, 1034 aa, Zea mays
MAEKLRDLSQPVDVTLLDATVAAFYGTGSKEERSAADQILRDLQNNPDMWLQVVHILQNSQNLNTKFFALQILESVIKYRWNALPVDQRDGIKNYISDVIVQARISIFTFRQERLYVNKLNIILVQLLSEEIFDFSRGEMTQQKIKELKSSLNSEFRLIHELCLYVLSATQRPELIRATLATLHAFLSWIPVGFIFESPLLETLLKFFPMAAYRNLTLQCLTEVAALQFGDFYNVQYVKTYTFFIIQLQAILPPEKIPDVYANGSTEEQAFIQNLALFFTSFFKNHMRILETTQENIAALLMGLEYLIGISYVDDTEVFKVSLDYWNVFVLELFEAHNQMEPAVTVSMMGLQAQMVPGMVDGGTAVKQRRQLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSNLATTIADLEPHQIHTFYESVGHMIQAESDNTNRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHIGKQFVPPMMDPVLGDYARNVPDARESEVLSLFATIINKYKGEMLEDVPRIFEAVFQCTLEMITKNFEDYPEHRLKFFSLLRAIGTHCFQALIQLSSQQLKLVIDSINWAFRHTERNIAETGLSLLLEILKKFQASGFQNQFYKTYFLTIEQEIFAVLTDTFHKPGFKLHVSVLQHLFCAVDGLTEPLWDASSVPYQYTDNAMFVRDYTIKLLGTSFPNMTVTEVTKFVDGLLSSKLDLPSFKNHIRDFLVQSKEFSVQDNKDLYAEEAAAQRERERQRMLAIPGLIAPSELQDEMVDS

SEQ ID NO: 2057 - protein, 1035 aa, Zea mays
MAEKLRDLSQPIDVTLLDATVAAFYGTGSKEERSAADQILRDLQNNPDMWLQVVHILQNSQNLNTKFFALQVLESVIKYRWNALPVEQRDGIKNYISDVIVQARINIFTFRQERLYVNKLNIILVQLLSEEIFDFSRGEMTQQKIKELKSSLNSEFRLIHELCLYVLSATQRPQLIRATLATLHAFLSWIPIGFIFESPLLETLLKFFPMAAYQNLTLQCLTEVAALQFGDFYNVQYVKMYTFFMIQLQAILPPEKIPDAYANGSTEEQAFIQNLALFFTSFFKNHMRILETTQENSAALLMGLEYLIGISYVDDTEVFKVCLDYWNVFVLELFEAHNEMEPAAAVSMMGLQTRMVPGMVDGTVTAVHQRRQLYSASLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSNLATTIADLEPHQIHTFYESVGHMIQAESDNTKRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHLGKQFVPPMMDPVLGDYARNVPDARESEVLSLFATIINKYKGEMLEDVPRIFEAVFQCTLEMITKNFEDYPEHRLKFFSLLRAIGTHCFQALIQLSSQQLKLVIDSINWAFRHTERNIAETGLSLLLEILKNFEASGFQNQFYKTYFLTIEQEIFAVLTDTFHKPGFKLHVLVLQHLFYVVDSLTEPLWDSSSVPYQYTDNAMFVRDYTIKLLGTSFPNMTVAEVTKFVDGLLSSKLDLPSFKNHIRDFLVQSKEFSAQDNKDLYAEEAAAQRERERQRMLAIPGLIAPSELQDEMVDS

SEQ ID NO: 2058 - protein, 1078 aa, Medicago truncatula
MAAEKLRDLSQPIDVPLLDATVAAFYGTGSKEQRTAADQILRELQNNPDMWLQVMHILQNTQNLNTKFFALQVLEGVIKYRWNALPVEQRDGMKNFISDVIVQLSRNEASFRTERLYVNKLNIILVQILKHEWPARWRNFIPDLVSAAKTSETICENCMAILKLLSEEVFDFSRGEMTQLKIKELKQSLNSEFQLIHELCLFVLSVSQRTELIRATLSTLHAFLSWIPLGYIFESPLLETLLKFFTMQAYRNLTLQCLTEVASLQFGNFYDAQYVKMYNIFMVQLQSILPPTTNIPEAYAHGSSDEQAFIQNLALFFTLFFKVHIRILESTQENISALLLGLEYLINISYVDDTEVFKVCLDYWNTLVSELFQPHRSLENSAAAATNMMGSQVSLMPPGMVDGLGPQLLQRRQLYAGPVSKLRMLMICRMAKPEEVLIVEDENGNIVRETMKDSDVLVQYKIMRETLIYLSHLDHDDTEKQMLGKLSKQLSGKDWTWNNLNTLCWAIGSISGSMGEEQENRFLVMVIRDLLNLCEITKGKDNKAVIASNIMYVVGQYPRFLRAHWKFLKTVVNKLFEFMHETHPGVQDMACDTFLKIVQKCRRKFVITQVGENEPFVSELLSGLSTTIADLEPHQIHTFYESVGSMIQAESDSQKRDEYLQRLMVLPNQKWMEIIGQARQNADFLKDQDVIRTVLNVLQTNTSVASSLGTYFLPQITLIFLDMLNVYRMYSELISKSIAEGTPFTSRTSYVKLLRSVKRETLKLIETFLDKAEDQPQIGKQFVPPMMDPVLGDYARNVPDARESEVLSLFATIINKYKASMIEDIPHIFEAVFQCTLEMITKNFEDYPEHRLKFFSLLRAIATHCFPALICLSSQQLKFVMDSIIWAFRHTERNIAETGLNLLLEMLNKFQASEFCNQFYRTYFLTIEQEIFAVLTDTFHKPGFKLHVLVLQHLLCLAESGALTEPLWDAATNSYPYPSNGAFVREYTIKLLSTSFPNMTAAEVTQFVNGLFESTNDLSTFKTHIRDFLIQSKEFSAQDNKDLYAEEAAAQRERERQRMLSIPGLIAPVELQDEMVDS

SEQ ID NO: 2059 - protein, 1077 aa, Medicago truncatula
MAAEKLRDLSSPIDVPLLDATVAAFYGTGSKQERSAADSILRDLQNNPDMWLQVMHILQNTQNLNTKFFALQVLEGVIKYRWNALPAEQRDGMKNFISDIIVQLSSNEASFRTERLYVNKLNIILVQILKHEWPARWRSFIPDLVAAAKTSETICENCMAILKLLSEEVFDFSRGEMTQQKIKELKQSLNSEFQLIHELCLYVLSASQRAELIRATLSTLHAFLSWIPLGYIFESPLLETLLKFFPVPAYRNLTLQCLTEVASLQFGNFYDVQYVKMYGILMGQLQTILPPNTNIPEAYAHGNSEEQAFIQNLALFFTSFFKVHIRILESTQENITTLLLGLEYLISISYVDDTEVFKVCLDYWNSLVSELFEPHRSLDNPAATANLMGLQVSSMLPGMVDGHGSQLLQRRQLYAGPMSKLRMLMICRMAKPEEVLIVEDENGNIVRETLKDNDVLVQYKIMRETLIYLAHLDHDDTEKQMLRKLSKQLSGEDWTWNNLNTLCWAIGSISGSMIEEQENRFLVMVIRDLLNLCEITKGKDNKAVIASNIMYVVGQYPRFLRAHWKFLKTVVNKLFEFMHETHPGVQDMACDTFLKIVQKCKRKFVITQVGENEPFVSELLSGLPITIADLEPHQIHSFYESVAHMIQAESDSQKRDEFLQRLMELPNQKWMEIIGQAHQNVDFLKDQDVIRTVLNILQTNTSVASSLGTFFLPQITMIFLDMLNVYRMYSELISKSILEGGPYASKTSYVKLLRSVKRETLKLIETFLDKAEDQPQIGKQFVPPMMDPVLGDYARNAPDARESEVLSLFATIVNKYKATMIEDVPRIFEAVFQCTLEMITKNFEDYPEHRLKFFSLLRAIATHCFPALICLSSQQLKLVMDSIMWAFRHTERNIAETGLNLLLEMLKKFQGSEFCNQFYRTYFLTTENEIFAVLTDTFHKPGFKLHVLVLQHLFCLLETGVLTEPLWDVATSPQSYPSNAVFVLEYTIKLLSASFPNMTTAEVTQFVNGLFESTNDLSTFKTHIRDFLIQSKEFSAQDNKDLYAEEAAAQRERERQRMLSIPGLIAPIELQDEMVDS

SEQ ID NO: 2060 - protein, 1076 aa, Populus trichocarpa
MAAEKFRDLSQAIDVPLLDATVAAFYGTGSKEERAAADRILQDLQSNPDMWLQVVHILQNTKNLNTKFFALQVLEGVIKYRWNALPVEQRDGMKNYISEVIVQLSSNEASFRMERLYVNKLNVTLVQILKHEWPARWRSFIPDLVAAAKTSETICENCMVILKLLSEEVFDFSRGEMTQQKIKELKQSLNSEFQLIHELCLYVLSASQRTELIQATLSTLHAFLSWIPLGYIFESPLLETLLKFFPMPSYRNLTLQCLTEVAALNFGDFYNMQYIKMYNFFMVQLQAILPSTTKIPEAYANGSSEEQAFIQNLALFFTSFYKSHIRVLESSQENISALLMGLEYLINISFVDDTEVFKVCLDYWNSLVLELFEPHHNLDTPAATVNMMGLQMPLLHGMVDGLGSQILQRRQLYAAPMSKLRMLMICRMAKPEEVLIVEDENGNIVRETMKDNDVLVQYKIMRETLIYLSHLDHEDTEKQMLKKLSKQLSGEDWNWNNLNTLCWAIGSISGSMMEEQENRFLVMVIRDLLNLCEITKGKDNKAVIASNIMYVVGQYPRFLRAHWKFLKTVVNKLFEFMHETHPGVQDMACDTFLKIVQKCKRKFVIVQVGESEPFVSELLSGLPTTVADLEPHQIHTFYESVGHMIQAESDLQKRDEYMQRLMDLPNQKWAEIIGQAHQSVDFLKDQEVIRTVLNILQTNTSVANSLGTYFLSQISLIFLDMLNVYRMYSELISSSIAEGGPYASKTSYVKLLRSVKRETLKLIETFLDKAEDQPQIGKQFVPPMMDPVLGDYARNLPDARESEVLSLFATIINKYKAAMIEDVPRIFEAVFQCTLEMITKNFEDYPEHRLKFFSLLRAIAAHCFPALIRLSSEQLKLVMDSIIWAFRHTERNIAETGLNLLLEMLKNFQASEFCNQFYRSYFLTIEQEIFAVLTDTFHKPGFKLHVLVLQHLFCSAESGALSEPLWDTTTVPYPYLNNAMFVREYTIKLLGTSFPNMTASEVTQFVNGLFESKNNLSIFKNHIRDFLVQSKEFSAQDNKDLYAEEAAVQRERERQRMLSIPGLIAPNEIQDEMLDS

SEQ ID NO: 2061 - protein, 1076 aa, Populus trichocarpa
MAAEKFRDLSQAIDVPLLDATVAAFYGTGSKEERVAADRILQDLQNNPDMWLQVVHILQNTKNLNTKFFALQVLEGVIKYRWNALPVEQRDGMKNYISEVIVQLSSNEASFRMERLYVNKLNVTLVQILKHEWPARWRSFIPDLVAAAKTSETICENCMVILKLLSEEVFDFSRGEMTQQKIKELKQSLNSEFQLIHELCLYVLSASQRTELIRATLSTLHAFLSWIPLGYIFESPLLETLLKFFPMPSYRNLTLQCLTEVAALNFGDFYNIQYVKMYNFFMVQLQAILPLTTNIPEAYANGSSEEQAFIQNLALFFTSFYKSHIQVLESTQENITALLMGLEYLINICYVDDTEVFKVCLDYWNSLVLELFEARHNLDNPAVAVNMMGLQMPLLHGMVDGLGSQILQRRQLYATPMSKLRMLMICRMAKPEEVLIVEDENGNIVRETMKDNDVLVQYKIMRETLIYLSHLDHEDTEKQMLKKLSKQLSGEDWNWNNLNTLCWAIGSISGSMMEEQENRFLVMVIRDLLNLCEITKGKDNKAVIASNIMYVVGQYPRFLRAHWKFLKTVVNKLFEFMHETHPGVQDMACDTFLKIVQKCKRKFVIVQVGESEPFVSELLAGLPTTVADLEPHQIHTFYESVGHMIQAESDPQKRDEYLQRLMDLPNQKWAEIIGQARQSVDFLKDQDVIRTVLNIMQTNTSVASALGTYFLSQISLIFLDMLNVYRMYSELISSSIAEGGPYASKTSYVKLLRSVKRETLKLIETFLDKAEDQTQIGKQFVPPMMDPVLGDYARNLPDARESEVLSLFATIINKYKAAMIEDVPRIFEAVFQCTLEMITKNFEDYPEHRLKFFSLLRAIATHCFPALIRLSSEQLKLVMDSIIWAFRHTERNIAETGLNLLVEMLKNFQASEFCNQFYRSYFLTIEQEIFAVLTDTFHKPGFKLHVLVLQHLFCLVESGALTEPLWDAATISYSYPNNAMFVREYTIKLLGTSFPNMTASEVTQFVNGLFESRNDLSAFKNHIRDFLVQSKEFSAQDNKDLYAEEAAAQRERERQRMLSIPGLIAPNEIQDEMLDS

SEQ ID NO: 2062 - protein, 1743 aa, Oryza sativa
MAEKLRDLSQPIDVPLLDATVAAFYGTGSKEERNAADQILRDLQNNPDMWLQVVHILQNSHNLNTKFFALQVLESVIKYRWNALPTEQRDGIKNYISDVIVQLSSNEASFRQERLYVNKLNIILVQVLKHEWPARWSSFVPDLVAAAKSSETICENCMAILKLLSEEIFDFSRGEMTQQKIKELKSSLNSEFRLIHELCLYVLSATQRPELIRATLATLHAFLSWIPVGFIFESPLLETLLKFFPMAAYRNLTLQCLTEVAALQFGDFYNVQYVKMYTIFMMQLQAILPPGTIPDAYANGSSEEQAFIQNLALFFTSFFKNHMRILEASPENRAALLLGLEYLIGISYVDDTEVFKVCLDYWNVFVLELFEAHNQMEPAASVNMMGLQAQMLPGVDGTITAVQQRRQLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSSLATTIGDLEPHQIHTFYESVGHMIQAESDNTKRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHIGKQFVPPMMDPILADYARNVPDARESEVLSLFATIINKYKGEMLEDVPRIFEAVFQCTLEMITKNFEDYPEHRLKFFSLLRAIGTHCFQALIQLSSQQLKLVIDSINWAFRHTERNIAETGLSLLLEILKNFQASGFQNQFYKTYFLNIEQEIFAVLTDTFHKPGFKLHVLVLQHLFCVVDGLTEPLWDASSVPYQYTDNAMFVRDYTIKLLGSSFPNMTPTEVTKFVDGLLSSKHDLPSFKNHIRDFLVQSKEFSAQDNKDLYAEEAAAQRERERQRMLAIPGLIAPSELQDEMLLRLLFYDAVCYVRDRGAWISPCICIKDILTQVVNLETAAATWRVITTMLSSQSRARALNTRLALSTTRKGDLSVTEYIGKMKTLADEMSSAGKPLDDEEMMSYILPGLDDDYEPVVSTLVGKAEAVPVAEIYTQLLSFESRAKLRQQANGSSVNSARRGGKGGGGGFSNNVNTGNTGAFRGRGGGRGDRGGRGRGNGGGARFSNKPRSTCQLCGKIGHVVADCWYRYDENFIPDSKTAAAASYGVDTNWYMDTGATDHITGELDKLTTHEKYNGKEQIHTASGAAVDNHAFVEVHPRFFAIKDQVTKNLLLRGPCRNGLYPLPTSSLATSKQVLGAIKPTMSRWHSRLGHPSLAIVQKVVSSNNLPCLGDVNESGVCNACQQAKSHQLPYPKSFSVSNNPLELVFSDVWGPAPTSVGGRKYYVSFIDDFSKFTWIYLLKSKAEVFLKFQEFQQRVERLFNRKIISMQTDWGGEYEKLHSFFTKIGISHHVSCPYAHQQNGSAERKHRHIVEVGLALLSHASMPLKFWDEAFLAAAYLINRTPSKQGEQSHAATSPSSHHDGGSDSPLTGGSSAPDTAVVEPARPVTHLQRGIRKQKVYTDGTVRYGMLTTTGEPQNLDEALTDKNWKDAMDAEFTALLENKTWHLIPPSHGKNVIDCKWVYKIKRKSDGDGAFAN

SEQ ID NO: 2063 - protein, 1075 aa, Solanum phureja
MAAEKLRDLSQPIDVSLLDATVAAFYGTGSKEERAAADHILRDLQNNPDMWLQVVHILSSTQSLNTKFFALQVLEGVIKYRWNALPVEQRDGMKNYISEVIVKLSSDEASLRRERLYISKLNIILVQILKHEWPARWRSFIPDLVAAAKTSETICENCMAILKLLSEEVFDFSRGEMTQQKIKELKQSLNSEFQLIHELCLYVLSVSHRTELIRATLATLHAFLSWIPLGYIFESTLLEILLKFFPMPSYRNLTLQCLTEVAALNFGDFYNEQYVKMYTIFMGQLQSVLPVNTNIPEAYANGSNEEQVCLRHIVSYKLLCMQSHIRVLESSQENISALLLGLEYVINISYVDDTEVFKVCLDYWNSLVLELFEAAHHNLDNPAMTANLMGLQMPLLSGMNDGLGAQLMQRRQLYSGPMSKLRLLMISRMAKPEEVLIVEDENGNIVRETMKDNDVLVQYKIMRETLIYLSHLDHDDTEKQMLKKLSNQLNGEDWSWNNLNTLCWAIGSISGSMVEEQENRFLVMVIRDLLNLCEITKGKDNKAVIASNIMYVVGQYPRFLRAHWKFLKTVVNKLFEFMHETHPGVQDMACDTFLKIVQKCKRKFVVVQVGENEPFVSELLTTLPTTIADLEPHQIHTFYESVGQMIQAEPDPQKRDEYLQRLMELPNQRWNEIIGQARQSVDYLKDQDVIRAVLNILQTNTSAASSLGTYFLPQITLIFLDMLNVYRMYSELISTSIAQGGPYASRTSIVKLLRSVKRETLKLIETFLDKAEDQPHIGKQFVPPMMDPVLGDYARNVPDARESEVLSLFATIINKYKGAMIEDVPRIFEAAFQCTLEMITKNFEDYPEHRLKFFSLLRAIATHCFAALIRLSSEQLKLVMDSIIWAFRHTERNIAETGLNLLLAMLKNFQNSEFANQFYRTYYLTIEQEIFAVLTDTFHKPGFKLHVLVLQHLFCMVAMLSEPLWDASTVPVSYPNNVEFVREYTIKLLSTSFPNMTSAEVTQFVSGLFDSTNDLPTFKNHIRDFLVQSKEFSAQDNKDLYAEEAAAQRERERQRMRSIPGLIAPNEIQDEMVDS

SEQ ID NO: 2064 - protein, 1035 aa, Sorghum bicolor
MAEKLRDLSQPIDVTLLDATVAAFYGTGSKEERSAADQILRDLQNNPDMWLQVVHILQNSQNLNTKFFALQVLESVIKYRWNALPVEQRDGIKNYISDVIVQLSSNEVTFRQERLYVNKLNIILVQLLSEEIFDFSRGEMTQQKIKELKSSLNSEFRLIHELCLYVLSATQRPELIRATLATLHAFLSWIPVGFIFESPLLETLLKFFPMAAYRNLTLQCLTEVAALQFGDFYNVQYVKMYTFFMIQLQAILPPEKIPDAYANGSTEEQAFIQNLALFFTSFFKNHMRILEITQENAAALLMGLEYLIGISYVDDTEVFKVCLDYWNVFVLELFEAHNQMEPAATVSMMGLQAQMVPGMVDGTGTAVQQRRQLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYPRFLRAHWKFLKTVVNKLFEFMHEMHPGVQDMACDTFLKIVQKCKRKFVTQQVGENEPFVSELLSNLATTIADLEPHQIHTFYESVGHMIQAESDNTKRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHIGKQFVPPMMDPVLGDYARNVPDARESEVLSLFATIINKYKGEMLEDVPRIFEAVFQCTLEMITKNFEDYPEHRLKFFSLLRAIGTHCFQALIQLSSPQLKLVIDSINWAFRHTERNIAETGLSLLLEILKNFQASGFQNQFYKTYFLTIEQEIFAVLTDTFHKPGFKLHVLVLQHLFCVVDGLTEPLWDASSVPYQYTDNAMFVRDYTIKLLGTSFPNMTVTEVTKFVDGLLSSKHDLPSFKNHIRDFLVQSKEFSAQDNKDLYAEEAAAQRERERQRMLAIPGLIAPSELQDEMVDS

SEQ ID NO: 2065 - protein, 1067 aa, Sorghum bicolor
MAAEKLRDLSQPIDVRLLDATVSAFYGTGSREERHAADQILRELQNNPDMWLQVVHILQNSQNLNTKFFALQVLENVIKYKWNALPVEQRDGMKNYISDVIVQLSSNEVSFRQERLYVNKLNIILVQVLKHEWPARWTTFIPDLIAAARSSETICENCMAILKLLSEEIFDFSRGEMTQQKIKELKTSLNSEFRLIHELCLYVLSVSQRPELVRATLATLHAFLSWIPISFIFESPLLETLLKFFPVAAYRNLTLQCLTEVAALHFGDFYDMQYVKMYEVFMLQLQAILPCGTISDGYANGSNEEQAFIQNLALLLTSFFKNHMRILEKTPENRAALLLGLDYLLEISFVDDTEMFKVCLDYWNLFVLELFETYNQVERLMELQTQRIPGTDDGTLIAVQQRRQLYARSLSKLRTLMICRMAKPEEVLIVEDENGNIVRETLKDNDVLVQYKIMRETLIYLSHLDHEDTEQQMLRKLSKQLNGEDWSWNNLNTLCWAIGSISGSMVEEQENRFLVLVIRDLLNLCEIMKGKDNKAVIASNIMYVVGQYPRFLRAHWKFLKTVVNKLFEFMHETHPGVQDMACDTFLKIVQKCKRKFVTLQVGENEPFVSVLLSNLPTTIADLEPHQIHTFYESVGQMIQAESDNTKREEYLKRLMSLPNQKWVEIIGEAGRSTDILKNQDVIRSVLNILQTNTGVACSLGPYFFPQISVIFLDMLTVYRMYSELVSNTISEGGPFASKTSFVKLLRSVKRETLKLIETFLDKAEDLPHLGKQFVPPMMDPVLGDYARNVPDARESEVLSLFAIIINKYKGEMLEEVPRIFEAVFQCTLEMITKNFEDYPEHRLKFFSLLRAIGTHCFQAFIQLSSQQLKLVMDSISWAFRHTERNIAETGLSLLLEILKNFEASGFQNQFYKTYFLNIEQEIFAVLTDTFHKPGFKLHVSVLQHLFYVVDGLTEPLWDASAVPSQFINNAMFVRDYTIKLLSSSFPNMTPVEVAKFVDGLFSSKTDPPNFKNHIRDFLVQSKEFSAQDNKDLYAEEAAAQREKERQRMLSIPGLIAPNELQDEMVDS

SEQ ID NO: 2066 - protein, 803 aa, Glycine max
MMPILRCIIYSWVSCRPYFRPLLIYPRHIHMVQVRNKHLYRIWHCSSPHFTRQVHVRILESTQENISALLLGLEYLINISYVDDTEVFKVCLDYWNVLVSELFEPNRSLENPAAANMIGLQVPGMIDGIGSQLLQHRQLYAGPMSKLRMLMICRMAKPEEVLIVEDENGNIVRETMKDNDVLVQYKIMRETLIYLSHLDHDDTEKQMLRKLSKQLSGEDWTWNNLNTLCWAIGSISGSMVEEQENRFLVMVIRDLLNLCEITKGKDNKAVIASNIMYVVGQYPRFLRAHWKFLKTVVNKLFEFMHESHPGVQDMACNTFLKIVQKCKRKFVITQVGENEPFVSELLSGLPNTIADLEPHQINTFYESVGNMIQAESDAQKRDEYLQKLMVLPNQRWMEIIGKAHQNADFLKDQDVIRNVLNILQTNTSVASSLGTYFLPQITLIFLDMLNVYRMFSELISKSIAEGGPFASRTSYVKLLRSVKRETLKLVETFLDKAEDQPQIGKQFVPPMMDPVLGDYARNVPDARESEVLSLFSTIVNKYKAAMVEDVPQIFEAVFQCTLEMITKNFEDYPEHRLKFFSLLRAIATHCFPALICLSSQQLKLVMDSIIWAFRHTERNIAETGLNLLLEMLKKFQESEFCNQFYRTYFLTIEQEIFAVLTDTFHKPGFKFHVLVLQHLFCLAETGALTEPLWDAATNPYSYPSNAAFVREFTINLLSTSFPNMTASEVTQFVNGLFESTNDLPTFETHIRDFLVQSKEFSAQDNKDLYAEEAAAQRERERQRMLSIPGLVAPSELQDEMVDS

SEQ ID NO: 2067 - protein, 1050 aa, Glycine max
RNAADQILRDLQNNPDMWLQVMHILQNTQNLNTKFFALQVLEGVIKYRWNALPVEQRDGMKNFISDVIVQLSSNEASFRAERLYVNKLNIILVQILKHEWPARWRSFIPDLVSAAKTSETICENCMAILKLLSEEVFDFSRGEMTQQKIKELKQSLNSEFQLIHELCLYVLSASQRTELIRATLSTLHAFLSWIPLGYIFESPLLETLLKFFPVPAYRNLTLQCLTEVAALQFVNYYDVQYVKMYNIFMVQLQGILPPTTNIPEAYGQGSSEEQAFIQNLALFFTSFYKASLIFSFHIRILESTQENIAALLVGLEYVINISYVDDTEVFKVCLDYWNSLVSELFEPHRSLDNPAAAATMMGLQVPAMLPGMVDGHGSQLLQRRQLYAGPMSKLRMLMICRMAKPEEVLIVEDENGNIVRETLKDNDVLVQYKIMRETLIYLSHLDHDDTEKQMLRKLSKQLSGEDWTWNNLNTLCWAIGSISGSMMEEQENRFLVMVIRDLLNLCEITKGKDNKAVIASNIMYVVGQYPRFLRAHWKFLKTVVNKLFEFMHETHPGVQDMACDTFLKIVQKCKRKFVITQVGENEPFVSELLTGLPITIADLEPHQIHSFYESVGHMIQAESDAQKRDEYLQRLMELPNQKWMEIIGQAHQNVDFLKDQDVIRTVLNIMQTNTSVATSLGTYFLPQISLIFLDMLNVYRMYSELISKSITEGGPFASRTSYVKLLRSVKRETLKLIETFLDKAEDQPQIGKQFVPPMMDPVLGDYSRNVPDARESEVLSLFATIVNKYKAAMIEDVPRIFEAVFQCTLEMITKNFEDYPEHRLKFFSLLRAIATHCFPALICLSSQQLKLVMDSIIWAFRHTERNIAETGLNLLLEMLKKFQGSEFCNQFYRTYFLTIEQEIFAVLTDTFHKPGFKLHVLVLQHLFCLLETGALTEPLWDVATSQYSYSSNAVFVREFTIKLLSTSFPNMTSAEVTQFVNGLFESTNDLSTFKNHIRDFLIQSKEFSAQDNKDLYAEEAAAQRERERQRMLSIPGLIAPSELQDEMVDS

SEQ ID NO: 2068 - protein, 755 aa, Solanum lycopersicum
MQSHIRVLESSQENIGALLVGLEYLINISYVDDTEVFKVCLDYWNSLVLELFEAAHHNLDNPAMTTNMMGLQMPLLSGMNDGLGAQLMQRRQLYSGPMSKLRLLMISRMAKPEEVLIVEDENGNIVRETMKDNDVLVQYKIMRETLIYLSHLDHDDTEKQMLKKLSNQLNGEDWSWNNLNTLCWAIGSISGSMVEEQENRFLVMVIRDLLNLCEITKGKDNKAVIASNIMYVVGQYPRFLRAHWKFLKTVVNKLFEFMHETHPGVQDMACDTFLKIVQKCKRKFVVVQVGENEPFVSELLTTLPTTIADLEPHQIHTFYESVGQMIQAEPDPQKRDEYLQRLMELPNQRWNEIIGQARQSVDYLKDQDVIRAVLNILQTNTSAASSLGTYFLPQISLIFLDMLNVYRMYSELISTSIAQGGPYASRTSIVKLLRSVKRETLKLIETFLDKAEDQSHIGKQFVPPMMDPVLGDYARNVPDARESEVLSLFATIINKYKGAMIEDVPRIFEAAFQCTLEMITKNFEDYPEHRLKFFSLLRAIATHCFAALIRLSSEQLKLVMDSIIWAFRHTERNIAETGLNLLLAMLKNFQNSEFANQFYRTYYLTIEQEIFAVLTDTFHKPGFKLHVLVLQHLFCMVVMLSEPLWDASTVPCSYPNNVEFVREYTIKLLSTSFPNMTAAEVTQFVSGLFDSTNDLPTFKNHIRDFLVQSKEFSAQDNKDLYAEEAAAQRERERQRMRSIPGLIAPNEIQDEMVDS

SEQ ID NO: 2069 - protein, 160 aa, Lolium multiflorum
MANPSQSRVALLLPVAALLAAALLLPLARSDADAGSNPTTAYDELRLRGFPRGLLPANVRGYTLDAGSGDFAVDLVSSCRIVLPAGSYLANFNDRLTGHLDDGRISGLSGISVKAFFRWWSITGIRADGDELVFEVGSVSAKFPARHFNASLECPAKADS

SEQ ID NO: 2070 - protein, 69 aa, Antirrhinum majus
MDALDTVFDPLRDFAKDSVRLVKRCHKPDRKEFTKVATRTAIGFVVMGFVGFFVKLIFIPINNIIVGAT

SEQ ID NO: 2071 - protein, 69 aa, Malus domestica
MDAIDSVVDPLREFSKDSIRLVKRCHKPDRKEFSKVALRTAIGFVVMGFVGFFVKLIFIPINNIIVGSV

SEQ ID NO: 2072 - protein, 69 aa, Malus domestica; identical to SEQ ID NO: 2071

SEQ ID NO: 2073 - protein, 69 aa, Malus domestica
MHALDSVFSPLREFSKDSVRLVKRCHKPDRKEFTKVALRTAIGFVVMGFVGFFEKLIFIPINNIIVGTA

SEQ ID NO: 2074 - protein, 69 aa, arabidopsis lyrata
MEAIDSAIDPLRDFAKSSVRLVQRCHKPDRKEFTKVAVRTAIGFVVMGFVGFFVKLVFIPINNIIVGSA

SEQ ID NO: 2075 - protein, 69 aa, arabidopsis lyrata
MDAIDSVVDPLRDFAKDSIRLVKRCHKPDRKEFTKVAVRTAIGFVVMGFVGFFVKLIFIPINNIIVGAT

SEQ ID NO: 2076 - protein, 69 aa, arabidopsis lyrata; identical to SEQ ID NO: 2075

SEQ ID NO: 2077 - protein, 69 aa, Arabidopsis thaliana
MEAIDSAIDPLRDFAKSSVRLVQRCHKPDRKEFTKVAVRTAIGFVVMGFVGFFVKLVFIPINNIIVGSS

SEQ ID NO: 2078 - protein, 69 aa, Arabidopsis thaliana; identical to SEQ ID NO: 2075

SEQ ID NO: 2079 - protein, 69 aa, Arabidopsis thaliana; identical to SEQ ID NO: 2075

SEQ ID NO: 2080 - protein, 69 aa, Artemisia annua
MDALDSVFEPLREFSKDSYRLVKRCHKPDRKEFSKVAVRTAIGFVVMGFVGFFVKLIFIPINNIIVGSV

SEQ ID NO: 2081 - protein, 69 aa, Brassica juncea
MDAIESAIDPLRDFAKSSVRLVQRCHKPDRKEFTKVAVRTAIGFVVMGFVGFFVKLVFIPINNIIVGST

SEQ ID NO: 2082 - protein, 64 aa, Brassica juncea
KEIAMDAIDSVVDPLRDFAKDSIRLVKRCHKPDRKEFTKVAVRTAIGFVVMGFVGFFVKLIFIP

SEQ ID NO: 2083 - protein, 69 aa, Brassica juncea; identical to SEQ ID NO: 2075

SEQ ID NO: 2084 - protein, 69 aa, Brassica juncea; identical to SEQ ID NO: 2075

SEQ ID NO: 2085 - protein, 84 aa, Brassica juncea
KIRKRKTQIKKKKYAMDAIDSVVDPLRDFAKDSIRLVKRCHKPDRKEFTKVAVRTAIGFVVMGFVGFFVKLIFIPINNIIVGAT

SEQ ID NO: 2086 - protein, 69 aa, Brassica juncea; identical to SEQ ID NO: 2075

SEQ ID NO: 2087 - protein, 73 aa, Brassica juncea
KERAMDAIDSVVDPLRDFAKDSIRLVKRCHKPDRKEFTKVAVRTAIGFVVMGFVGFFVKLIFIPINNIIVGAT

SEQ ID NO: 2088 - protein, 64 aa, Brassica juncea
SAIDPLRDFAKSSVRLVQRCHKPDRKEFTKVAVRTAIGFVVMGFVGFFVKLVFIPINNIIVGSS

SEQ ID NO: 2089 - protein, 69 aa, Brassica oleracea; identical to SEQ ID NO: 2075

SEQ ID NO: 2090 - protein, 69 aa, Brassica oleracea; identical to SEQ ID NO: 2075

SEQ ID NO: 2091 - protein, 71 aa, Brassica oleracea
EAMDAIDSAIDPLRDFAKSSARLVQRCHKPDRKEFTMVAVRTAIGFVVMGFVGFFVKLVFIPINNIIVGSS

SEQ ID NO: 2092 - protein, 69 aa, Brassica rapa; identical to SEQ ID NO: 2075

SEQ ID NO: 2093 - protein, 69 aa, Brassica rapa; identical to SEQ ID NO: 2075

SEQ ID NO: 2094 - protein, 82 aa, Brassica rapa
IIKFKSKQRTIIAMDAIDSVVDPLRDFAKDSIRLVKRCHKPDRKEFTKVAVRTAIGFVVMGFVGFFVKLIFIPINNIIVGAT

SEQ ID NO: 2095 - protein, 69 aa, Brassica rapa; identical to SEQ ID NO: 2075

SEQ ID NO: 2096 - protein, 69 aa, Musa acuminata
MDALDSAVDPLREFAKDSVRLVKRCHKPDRKEFSKVAVRTAIGFVVMGFVGFFVKLIFIPINNIIVGSG

SEQ ID NO: 2097 - protein, 69 aa, Musa acuminata
MDALDSVVDPLREFAKDSLRLVKRCHKPDRKEFTKVAVRTAIGFVVMGFVGFFVKLIFIPINNIIVGSG

SEQ ID NO: 2098 - protein, 69 aa, Musa acuminata
MDALDSAVDPLREFAKDSVRLVKRCHKPDRKEFTKVAIRTAIGFVVMGFVGFFVKLIFIPINNIIVGSG

SEQ ID NO: 2099 - protein, 69 aa, Musa acuminata
MDALDSVVDPLREFAKDSLRLVKRCHKPDRKEFTKVAIRTAIGFVVMGFVGFFGKLIFIPINNIIVGSG

SEQ ID NO: 2100 - protein, 69 aa, Hordeum vulgare; identical to SEQ ID NO: 249

SEQ ID NO: 2101 - protein, 69 aa, Hordeum vulgare; identical to SEQ ID NO: 249

SEQ ID NO: 2102 - protein, 69 aa, Hordeum vulgare
MDAVDSVVDPLREFAKDSVRLVKRCHKPDRKEFTKVAIRTAIGFVVMGFVGFFVKLIFIPINNIIVGSG

SEQ ID NO: 2103 - protein, 69 aa, Hordeum vulgare; identical to SEQ ID NO: 249

SEQ ID NO: 2104 - protein, 71 aa, Phaseolus coccineus
MDAIDSVFDPLREFSKDSVRLVKRCHKPDRKEFSKVAVRTAIGFVVMGFVRFFCQAHLHSNQQHHCRIWLG

SEQ ID NO: 2105 - protein, 69 aa, Phaseolus coccineus
MDAIDSVFDPLREFAKDSVRLVKRCHKPDRKEFSKVAVRTAIGFVVMGFVGFFVKLIFIPINNIIVGSG

SEQ ID NO: 2106 - protein, 69 aa, Fagus grandifolia
  misc_feature (69)..(69): Xaa can be any naturally occurring amino acid
MDAIDSVVDPLREFSKDSIRLVKRCHKPDRKEFTKVAFRTAIGFVVMGFVGFFVKLIFIPINNIIVGSX

SEQ ID NO: 2107 - protein, 67 aa, Fagus grandifolia
MEAIDSVFDPLREFSKDSIRLVKRCHKPDRKEFTKVAFRTAIGFVVMGFVGFFVKLIFIPINNIIVG

SEQ ID NO: 2108 - protein, 69 aa, Brachypodium distachyon; identical to SEQ ID NO: 249

SEQ ID NO: 2109 - protein, 69 aa, Brachypodium distachyon
MDAVDSVVDPLRDFTKDSVRLVKRCHKPDRKEFTKVAVRTATGFVAMGFVGFFVKLIFIPINNIIVGSG

SEQ ID NO: 2110 - protein, 69 aa, Bruguiera gymnorhiza
MDAVDSVVDPLRDFAKDSVRLVKRCHKPDRKEFTKVAVRTAIGFVVMGFVGFFVKLIFIPINNIIVGSV

SEQ ID NO: 2111 - protein, 69 aa, Bruguiera gymnorhiza
MDAVDSVVDPLRDFAKDSARLVKRCHKPDRKEFTKVAFRTAIGFVVMGFVGFFVKLIFIPINNIIVGSG

SEQ ID NO: 2112 - protein, 69 aa, Theobroma cacao
MDALDSVVDPLRDFAKDSVRLVKRCHKPDRKEFTKVAFRTAIGFVVMGFVGFFVKLIFIPINNIIVGSA

SEQ ID NO: 2113 - protein, 69 aa, Theobroma cacao
  misc_feature (9)..(10): Xaa can be any naturally occurring amino acid
  misc_feature (21)..(21): Xaa can be any naturally occurring amino acid
MDALDSVVXXLRDFAKDSFRXVKRCHKPVRKEFTKVAFRIAIGFVVMGFVGFFVKLIFILINNIIVGSV

SEQ ID NO: 2114 - protein, 69 aa, Theobroma cacao
  misc_feature (9)..(9): Xaa can be any naturally occurring amino acid
  misc_feature (29)..(29): Xaa can be any naturally occurring amino acid
  misc_feature (34)..(34): Xaa can be any naturally occurring amino acid
  misc_feature (42)..(42): Xaa can be any naturally occurring amino acid
MDAIDSVFXPLREFAKDSVRLVKRCHKPXRKEFXKVAFRTAXGFVVMGFVGFFVKLIFIPINNIIVGSG

SEQ ID NO: 2115 - protein, 79 aa, Brassica napus
FKSKQRTIIAMDAIDSVVDPLRDFAKDSIRLVKRCHKPDRKEFTKVAVRTAIGFVVMGFVGFFVKLIFIPINNIIVGAT

SEQ ID NO: 2116 - protein, 90 aa, Brassica napus
CQTKKGKTNRKKKRSRKKERDMDAIDSVVDPLRDFAKDSIRLVKRCHKPDRKEFTKVAVRTAIGFVVMGFVGFFVKLIFIPINNIIVGAT

SEQ ID NO: 2117 - protein, 81 aa, Brassica napus
INAEYAGIESKAMDAIDSVVDPLRDFAKDSIRLVKRCHKPDRKEFTKVAVRTAIGFVVMGFVGFFVKLIFIPINNIIVGAT

SEQ ID NO: 2118 - protein, 98 aa, Brassica napus
LVSLRTNPENKKRKTQIKLKKREKVKEIAMDAIDSVVDPLRDFAKDSIRLVKRCHKPDRKEFTKVAVRTAIGFVVMGFVGFFVKLIFIPINNIIVGAT

SEQ ID NO: 2119 - protein, 73 aa, Brassica napus
ESKAMDAIDSVVDPLRDFAKDSIRLVKRCHKPDRKEFTKVAVRTAIGFVVMGFVGFFVKLIFIPINNIIVGAT

SEQ ID NO: 2120 - protein, 69 aa, Brassica napus; identical to SEQ ID NO: 2075

SEQ ID NO: 2121 - protein, 98 aa, Brassica napus
HFPFFFPHRAKPKKERQIKKQRSSKKERAMDAIDSVVDPLRDFAKDSIRLVKRCHKPDRKEFTKVAVRTAIGFVVMGFVGFFVKLIFIPINNIIVGAT

SEQ ID NO: 2122 - protein, 69 aa, Brassica napus; identical to SEQ ID NO: 2075

SEQ ID NO: 2123 - protein, 69 aa, Brassica napus
MDAIDSAIDPLRDFAKSSARLVQRCHKPDRKEFTMVAVRTAIGFVVMGFVGFFVKLVFIPINNIIVGSS

SEQ ID NO: 2124 - protein, 69 aa, Brassica napus
MDAIDSAIDPLRDFAKSSVRLVQRCHKPDRKEFTKVAVRTAIGFVVMGFVGFFVKLVFIPINNIIVGSS

SEQ ID NO: 2125 - protein, 69 aa, Manihot esculenta
MDAIDSVFDPLREFAKDSVRLVKRCHKPDRKEFTKVAFRTAIGFVVMGFVGFFVKLIFIPINNIIVGSS

SEQ ID NO: 2126 - protein, 69 aa, Manihot esculenta; identical to SEQ ID NO: 2125

SEQ ID NO: 2127 - protein, 69 aa, Manihot esculenta; identical to SEQ ID NO: 2125

SEQ ID NO: 2128 - protein, 69 aa, Ricinus communis
MDALDNVFDPLRDFAKDSVRLVKRCHKPDRKEFTKVAFRTAIGFVVMGFVGFFVKLIFIPINNIIVGSG

SEQ ID NO: 2129 - protein, 69 aa, Ricinus communis
MDAIDSVLDPLRDFSKDSVRLVKRCHKPDRKEFTKVAFRTAIGFVVMGFVGFFVKLIFIPINNIIVGSV

SEQ ID NO: 2130 - protein, 69 aa, Catharanthus roseus
MDALDSVFDPLRDFAKDSVRLVKRCHKPDRKEFTKVATRTAIGFVVMGFVGFFVKLIFIPINNIIVGAS

SEQ ID NO: 2131 - protein, 69 aa, Catharanthus roseus; identical to SEQ ID NO: 2130

SEQ ID NO: 2132 - protein, 69 aa, Catharanthus roseus
MDALDSVFDPLRDFAKDSVRLVKRCHKPDRKEFFKVAVRTAIGFVVMGFVGFFVKLIFIPINNIIVGSG

SEQ ID NO: 2133 - protein, 69 aa, Centaurea maculosa
MDALDSVFEPLREFSKDSYRLVKRCHKPDRKEFSKVAVRTAIGFVVMGFVGFFVKLIFIPINNIITGSV

SEQ ID NO: 2134 - protein, 69 aa, Centaurea maculosa
MDAIDSVIDPLRDFAKDSARLVKRCHKPDRKEFTKVASRTAIGFVVMGFVGFFVKLIFIPINNIIVGAS

SEQ ID NO: 2135 - protein, 69 aa, Castanea mollissima
MDAIDSVVDPLREFAKDSVRLVKRCHKPDRKEFTKVAFRTAIGFVVMGFVGFFVKLIFIPINNIIVGSA

SEQ ID NO: 2136 - protein, 69 aa, Castanea mollissima
MEAIDSVFDPLREFAKDSVRLVKRCHKPDRKEFTKVAFRTAIGFVVMGFVGFFVKLIFIPINNIIVGSS

SEQ ID NO: 2137 - protein, 63 aa, Cichorium intybus
MVSRGFGMVWGVGNLVEAGNKPNFQTTGKTRFNDPMNYGVSLFPPHPFQIPNSLLDLTVLSIS

SEQ ID NO: 2138 - protein, 69 aa, Citrus sinensis
MDAIDNVFDPLRDFAKDSLRLVKRCHKPDRKEFTKVAFRTAIGFVVMGFVGFFVKLIFIPINNIIVGSG

SEQ ID NO: 2139 - protein, 69 aa, Coffea canephora
MDALDSVFDPLRDFAKDSVRLVKRCHKPDRKEFSKVAVRTAIGFVVMGFVGFFVKLIFIPINNIIVGSA

SEQ ID NO: 2140 - protein, 102 aa, Coffea canephora
  misc_feature (88)..(88): Xaa can be any naturally occurring amino acid
PLFLYIFFFLSPPQNFPIFVGKKRDFHFLEKIKMDALDSVFDPLRDFAKDSVRLVKRCHKPDRKEFTKVATRTAIGFVVMGFVGFFVXLIFIPINNIIVGAS

SEQ ID NO: 2141 - protein, 69 aa, Gossypium hirsutum
MDAIDSVFDPLREFAKDSVRLVKRCHKPDRKEFTKVAVRTAIGFVVMGFVGFFVKLIFIPINNIIVGSS

SEQ ID NO: 2142 - protein, 69 aa, Gossypium hirsutum
MDAIDSVFDPLREFAKDSVRLVKRCHKPDRKEFTKVAFRTAIGFVVMGFVGFFVKLIFIPINNIIVGSG

SEQ ID NO: 2143 - protein, 69 aa, Gossypium hirsutum
MDALDNVVDPLRDFAKDSVRLVKRCHKPDRKEFTKVAFRTAIGFVVMGFVGFFVKLIFIPINNIIVGSA

SEQ ID NO: 2144 - protein, 69 aa, Gossypium hirsutum
MDAIDSVFDPLREFAKDSVRLVKRCHKPDRKEFTKVAVRTAIGFVVMGFVGFFVKLIFIPINNIIVGSG

SEQ ID NO: 2145 - protein, 75 aa, Gossypium hirsutum
KPGKGKMDAIDSVFDPLREFAKDSVRLVKRCHKPDRKEFTKVAFRTAIGFVVMGFVGFFVKLIFIPINNIIVGSG

SEQ ID NO: 2146 - protein, 83 aa, Gossypium hirsutum
QLPSTFVSRSRPVAMDAIDSVVDPLRDFAKDSVRLVKRCHKPDRKEFTKVAARTAIGFVVMGFVGFFVKLIFIPINNIIVGSG

SEQ ID NO: 2147 - protein, 69 aa, Vigna unguiculata; identical to SEQ ID NO: 2105

SEQ ID NO: 2148 - protein, 96 aa, Vigna unguiculata
AGRQKDSTPISILESKVGRQRECVRETMDAIDSVFDPLREFAKDSVRLVKRCHKPDRKEFSKVAVRTAIGFVVMGFVGFFVKLIFIPINNIIVGSG

SEQ ID NO: 2149 - protein, 69 aa, Cryptomeria japonica
MEAVDTVVQPLKEFAKDSIRLVKRCHKPDRKEFSKVAFRTAIGFVVMGFVGFFVKLIFIPINNIIVGSG

SEQ ID NO: 2150 - protein, 70 aa, Cryptomeria japonica
IMEAVDTVVQPLKEFAKDSIRLVKRCHKPDRKEFSKVAFRTAIGFVVMGFVGFFVKLIFIPINNIIVGSG

SEQ ID NO: 2151 - protein, 81 aa, cucumber
VPNYQNFLSSSRGTDAIDSVVDPLRAFAKDSLRLVKRCHKPDRNEFTKVAFRTAIGFVVMGFVGFFVNLIFIPINNIIVGS

SEQ ID NO: 2152 - protein, 69 aa, cucumber
MDAVDSVVDPLREFAKDSVRLVKRCHKPDRKEFTKVAVRTAIGFVVMGFVGFFVKLIFIPINNIIVGSG

SEQ ID NO: 2153 - protein, 69 aa, cucumber; identical to SEQ ID NO: 2144

SEQ ID NO: 2154 - protein, 69 aa, Cycas rumphii
MEAVETVVRPLQDFAKDSVRLVKRCHKPDRKEFSKVAFRTAIGFVVMGFVGFFVKLIFIPINNIIVGSG

SEQ ID NO: 2155 - protein, 69 aa, Cynara scolymus; identical to SEQ ID NO: 2080

SEQ ID NO: 2156 - protein, 101 aa, Taraxacum officinale
VYPCSLVSLFPPHLLSIPNSLFRSDFSLDLLIMDALDSVFEPLREFSKDSYRLVKRCHKPDRKEFSKVAVRTAIGFVVMGFVGFFVKLIFIPINNIIVGSV

SEQ ID NO: 2157 - protein, 84 aa, Taraxacum officinale
LLSHNTPLHCSPSSTMDAIDSVIDPLREFAKDSTRLVKRCHKPDRKEFIKVASRTAIGFVVMGFVGFFVKLIFIPINNIIVGAS

SEQ ID NO: 2158 - protein, 69 aa, Eucalyptus gunnii
MDAIDSAVDPLREFAKDSLRLVKRCHKPDRKEFTKVAFRTAIGFVVMGFVGFFVKLIFIPINNIIVGSA

SEQ ID NO: 2159 - protein, 69 aa, Adiantum capillus-veneris
MDAVEGVITPIKDFAKDSVRLVKRCHKPDRKEFTKVAFRTAIGFVVMGFVGFFVKLIFIPINNIIVGSG

SEQ ID NO: 2160 - protein, 89 aa, Festuca arundinacea
HEAFPRARLVSEISLARAPAMDAVDSVVDPLREFAKDSVRLVKRCHKPDRKEFTKVAARTAIGFVVMGFVGFFVKLIFIPINNIIVGSG

SEQ ID NO: 2161 - protein, 94 aa, Festuca arundinacea
HEAAFSLPRARLVSSRLGDLAGPPAMDAVDSVVDPLREFAKDSVRLVKRCHKPDRKEFTKVAARTAIGFVVMGFVGFFVKLIFIPINNIIVGSG

SEQ ID NO: 2162 - protein, 69 aa, Linum usitatissimum
MDAIDNVFDPLREFAKDSVRLVKRCHKPDRKEFSKVAVRTAIGFVVMGFVGFFVKLIFIPINNIIVGSG

SEQ ID NO: 2163 - protein, 69 aa, Gerbera hybrid cultivar
MDALDSVFDPLREFSKDSYRLVKRCHKPDRKEFSKVAIRTAIGFVVMGFVGFFVKLIFIPINNIIVGSV

SEQ ID NO: 2164 - protein, 63 aa, Gerbera hybrid cultivar
VIDPLREFAKDSARLVKRCHKPDRKEFTKVASRTAIGFVVMGFVGFFVKLIFIPINNIIVGAS

SEQ ID NO: 2165 - protein, 52 aa, Zingiber officinale
MEESAKKICKAARGIPEGHCVIILAHNGPTGLSLNWMMIVHSFNNPDFYLQD

SEQ ID NO: 2166 - protein, 69 aa, Zingiber officinale
MDALDSVVDPLREFSKDSIRLVKRCHKPDRKEFTKVAVRTAIGFVVMGFVGFFVKLIFIPINNIIVGSG

SEQ ID NO: 2167 - protein, 69 aa, Vitis vinifera
MDAIDNVFDPMREFAKDSVRLVKRCHKPDRKEFTKVAFRTAIGFVVMGFVGFFVKLIFIPINNIIVGSV

SEQ ID NO: 2168 - protein, 69 aa, Vitis vinifera
MDAIDSAVDPLREFSKDSVRLVKRCHKPDRKEYTKVAFRTATGFVVMGFVGFFVKLIFIPINNIIVGSG

SEQ ID NO: 2169 - protein, 69 aa, Mesembryanthemum crystallinum
MDAIDNVVDPLREFSRDSVRLVKRCHKPDQKEFTKVAFRTAVGFVVMGFVGFFVKLIFIPINNIIVGST

SEQ ID NO: 2170 - protein, 82 aa, Ipomoea nil
ISDRNHKKRRIQVMDALDTVFDPLRDFAKDSVRLVKRCHKPDRKEFSKVAVRTAIGFVVMGFVGFFVKLIFIPINNIIVGSA

SEQ ID NO: 2171 - protein, 93 aa, Ipomoea nil
  misc_feature (19)..(20): Xaa can be any naturally occurring amino acid
  misc_feature (22)..(22): Xaa can be any naturally occurring amino acid
  misc_feature (52)..(52): Xaa can be any naturally occurring amino acid
TSVPGQIQILNPIPIAEAXXSXESMDALDAVFDPLRDFAKDSVRLVKRCHKXDRKEFSKVAVRTAIGFVVMGFVGFFVKLIFIPINNIIVGSA

SEQ ID NO: 2172 - protein, 66 aa, Ipomoea nil
MDALDSVFDPLRDFAKDSVRLVKRCHKPDRKEFSKVAVRTAIGFVVMGFVGFFVKLIFIPINNIIV

SEQ ID NO: 2173 - protein, 69 aa, Jatropha curcas
MDALDSVFDPLREFAKDSVRLVKRCHKPDRKEFTKVAYRTAIGFVVMGFVGFFVKLIFIPINNIIVGSS

SEQ ID NO: 2174 - protein, 69 aa, Actinidia deliciosa
MDALDSVIDPLREFAKDSTRLVKRCHKPDQKEFTKVAFRVAIGFVVMGFVGFFVKLIFIPINNIIVGSA

SEQ ID NO: 2175 - protein, 69 aa, Actinidia deliciosa
MDALDSVFDPLREFAKDSVRLVKRCHKPDRKEFTKVAFRTAIGFVVMGFVGFFVKLIFIPINNIIVGSG

SEQ ID NO: 2176 - protein, 69 aa, Lactuca sativa; identical to SEQ ID NO: 2080

SEQ ID NO: 2177 - protein, 69 aa, Lactuca sativa
MDAIDSVIDPLRGFAKDSARLVKRCHKPDRKEFTKVASRTAIGFVVMGFVGFFVKLIFIPINNIIVGAS

SEQ ID NO: 2178 - protein, 74 aa, Lactuca sativa
LEASTMDATDSVIDPLRGLLRTAARLVKRCHKPDRKEFTKVASRTAIGFVVMGFVGFFVKLIFIPINNIIVGAS

SEQ ID NO: 2179 - protein, 69 aa, Lactuca sativa; identical to SEQ ID NO: 2080

SEQ ID NO: 2180 - protein, 99 aa, Lactuca sativa
PLLSSSYFFRISIQIPNSLSRSDISLDLLIMDALDSVFEPLREFSKDSYRLVKRCHKPDRKEFSKVAVRTAIGFVVMGFVGFFVKLIFIPINNIIVGSV

SEQ ID NO: 2181 - protein, 69 aa, Glycyrrhiza uralensis; identical to SEQ ID NO: 2105

SEQ ID NO: 2182 - protein, 69 aa, Liriodendron tulipifera
MDALDSVVDPLREFAKDSARLVKRCHKPDRKEFTKVAIRTAIGFVVMGFVGFFVKLIFIPINNIIVGSG

SEQ ID NO: 2183 - protein, 69 aa, Liriodendron tulipifera
MDAIDSVIDPLRDFAKDSVRLVKRCHKPDRKEFTKVAIRTAIGFVVMGFVGFFVKLIFIPINNIIVGSG

SEQ ID NO: 2184 - protein, 69 aa, Lolium multiflorum
MDAVDSVVDPLREFAKDSVRLVKRCHKPDRKEFTKVAARTAIGFVVLGFVGFFVKLIFIPINNIIVGSG

SEQ ID NO: 2185 - protein, 69 aa, Lotus japonicus
MEAIDSVFDPLREFAKDSVRLVKRCHKPDRKEFSKVAVRTAIGFVVMGFVGFFVKLIFIPINNIIVGSG

SEQ ID NO: 2186 - protein, 69 aa, Lotus japonicus
MEAIDSVFDPLREFSKDSIRLVKRCHKPDRKEFSKVAVRTAIGFVVMGFVGFFVKLIFIPINNIIVGSG

SEQ ID NO: 2187 - protein, 69 aa, Eragrostis curvula
MDAVDSVVDPLREFAKDSVRLVKRCHKPDRKEFTKVATRTAIGFVVMGFVGFFVKLIFIPINNIIVGSG

SEQ ID NO: 2188 - protein, 69 aa, Zea mays
MDAIDSVVDPLRDFAKDSVRLVKRCHKPDRKEFTKVAARTAIGFVVMGFVGFFVKLIFIPINNIIVGSG

SEQ ID NO: 2189 - protein, 69 aa, Zea mays
MDAVDSVVDPLREFAKDSIRLVKRCHKPDRKEFTKVAARTAIGFVVMGFVGFFVKLIFIPINNIIVGSG

SEQ ID NO: 2190 - protein, 69 aa, Zea mays
MDAVDSVVDPLREFAKDSIRLVKRCHKPDRKEFTKVAARTAIGFIVMGFVGFFVKLIFIPINNIIVGSG

SEQ ID NO: 2191 - protein, 69 aa, Zea mays; identical to SEQ ID NO: 2188

SEQ ID NO: 2192 - protein, 64 aa, Zea mays
MNTERRLGFAKDSIRLVKRCHKPDRKEFTKVAARTAIGFVVMGFVGFFVKLIFIPINNIIVGSG

SEQ ID NO: 2193 - protein, 69 aa, Zea mays; identical to SEQ ID NO: 2102

SEQ ID NO: 2194 - protein, 69 aa, Zea mays
MDAVDSVVDPLRDFAKDSVRLVKRCHKPDRKEFTKVAARTAIGFVVMGFVGFFVKLIFIPINNIIVGSG

SEQ ID NO: 2195 - protein, 69 aa, Marchantia polymorpha
MEAVDTVVRPVKEFAKDSIRLVKRCHKPDRREFTKVAARTALGFVVMGFIGFFVKLIFIPINNIIVGSG

SEQ ID NO: 2196 - protein, 69 aa, Medicago truncatula; identical to SEQ ID NO: 2105

SEQ ID NO: 2197 - protein, 69 aa, Medicago truncatula; identical to SEQ ID NO: 2105

SEQ ID NO: 2198 - protein, 69 aa, Medicago truncatula
MDAIDSVFDPLREFAKAALGSFKRCHKPDRKEFSKVAVRTAIGFVVMGFVGFFVKLIFIPINNIIVGSG

SEQ ID NO: 2199 - protein, 101 aa, Cucumis melo
KEVNPSGFRLQSFRRISSPFPNYQNFLSSSWGMDAIDSVVDPLRAFAKDSVRLVKRCHKPDRNEFTKVAVRTAIGFVVMGFVGFFVKLIFIPINNIIVGSG

SEQ ID NO: 2200 - protein, 96 aa, Cucumis melo
ATIRSKTANQISPKTFLLSTLPSHLGAMDAVDSVVDPLREFAKDSVRLVKRCHKPDRKEFTKVAVRTAIGFVVMGFVGFFVKLIFIPINNIIVGSG

SEQ ID NO: 2201 - protein, 69 aa, Cucumis melo; identical to SEQ ID NO: 2144

SEQ ID NO: 2202 - protein, 69 aa, Pennisetum glaucum; identical to SEQ ID NO: 2189

SEQ ID NO: 2203 - protein, 69 aa, Mimulus guttatus
MDALDSVFDPLRDFAKDSVRLVKRCHKPDRKEFTKVATRTAIGFVVMGFVGFFVKLIFIPINNIIVGAT

SEQ ID NO: 2204 - protein, 69 aa, Nuphar advena
  misc_feature (16)..(16): Xaa can be any naturally occurring amino acid
MDAVDSVVDPLREFAXDSVRLVKRCHKPDRKEFTKVAFRTAIGFVVMGFVGFFVKLIFIPINNIIVGSG

SEQ ID NO: 2205 - protein, 69 aa, Quercus alba
MDAIDSVVDPLRDFAKDSVRLVKRCHKPDRKEFTKVAFRTAIGFVVMGFVGFFVKLIFIPINNIIVGSA

SEQ ID NO: 2206 - protein, 73 aa, Quercus alba
MEAIDSVFDPPQRIRQGQRPPRQTLPQTRPQRVHQGGVPYGHRVRGYGVRWLLRQAHLHPHQQHHRWLLLMSV

SEQ ID NO: 2207 - protein, 69 aa, Elaeis guineensis
MDALDSAVDPLRDFAKDSIRLVKRCHKPDRKEFTKVAFRTAIGFVVMGFVGFFVKLIFIPINNIIVGSG

SEQ ID NO: 2208 - protein, 69 aa, Allium cepa
MDAVDSIVDPLREFAKDSVRLVKRCHKPDRKEFTKVAFRTAIGFVVMGFVGFFVKLIFIPINNIIVGSG

SEQ ID NO: 2209 - protein, 69 aa, Carica papaya
MDALDTVVDPLRDFAKDSVRLVKRCHKPDRKEFTKVAFRTAIGFVVMGFVGFFVKMVFIPINNIIVGSS

SEQ ID NO: 2210 - protein, 69 aa, Arachis hypogaea; identical to SEQ ID NO: 2105

SEQ ID NO: 2211 - protein, 69 aa, Arachis hypogaea; identical to SEQ ID NO: 2105

SEQ ID NO: 2212 - protein, 69 aa, Arachis hypogaea
MDAIDSVFEPLRGFSKDSVRLVKRCHKPDRKEYFKVAVSTAIGITVMGFVGFFVKLIFTPVNNIIVGSG

SEQ ID NO: 2213 - protein, 69 aa, Arachis hypogaea; identical to SEQ ID NO: 2105

SEQ ID NO: 2214 - protein, 69 aa, Capsicum annuum; identical to SEQ ID NO: 2130

SEQ ID NO: 2215 - protein, 69 aa, Capsicum annuum
MDALDTVFDPLRDFAKDSVRLVKRCHKPDRKEFTKVATRTAIGFVVMGFVGFFVKLIFIPINNIIVGAS

SEQ ID NO: 2216 - protein, 67 aa, Petunia hybrida
GLDSVFDPLRDFAKDSVRLVKRCHKPDRKEFTKVATRTAIGFVVMGFVGFFVKLIFIPINNIIVGAS

SEQ ID NO: 2217 - protein, 66 aa, Petunia hybrida
LDSVFDPLRDFAKDSVRLVKRCHKPDRKEFTKVATRTAIGFVVMGFVGFFVKLIFIPINNIIVGAS

SEQ ID NO: 2218 - protein, 69 aa, Physcomitrella patens
MEAVDTVVRPVKDFAKDSIRLVKRCHKPDRREFSKVAIRTALGFIVMGFIGFFVKLIFIPINNIIVGSG

SEQ ID NO: 2219 - protein, 69 aa, Physcomitrella patens; identical to SEQ ID NO: 2218

SEQ ID NO: 2220 - protein, 69 aa, Pinus taeda
MDAVDTVVRPLKDFAKDSVRLVKRCHKPDRKEFSKVAFRTAIGFVVMGFVGFFVKLIFIPINNIIVGSG

SEQ ID NO: 2221 - protein, 69 aa, Pinus taeda; identical to SEQ ID NO: 2220

SEQ ID NO: 2222 - protein, 69 aa, Pinus taeda
MEAVDAVVRPLQDFAKDSVRLVKRCHKPDRKEFSKVAFRTAIGFVVMGFVGFFVKLIFIPINNIIVGSG

SEQ ID NO: 2223 - protein, 69 aa, Populus trichocarpa
MDAIDSVFDPLREFSKDSVRLVKRCHKPDRKEFTKVAFRTAIGFVVMGFVGFFVKLIFIPINNIIVGSV

SEQ ID NO: 2224 - protein, 69 aa, Populus trichocarpa
MDAIDSVVDPLREFAKDSVRLVKRCHKPDQKEFTKVASRTAIGFVVMGFVGFFVKLIFIPINNIIVGAS

SEQ ID NO: 2225 - protein, 69 aa, Populus trichocarpa
MDAIDSVVDPLREFAKDSVRLVKRCHKPDQKEFTKVATRTAIGFVVMGFVGFFVKLIFIPINNIIVGAS

SEQ ID NO: 2226 - protein, 63 aa, Papaver somniferum
VVDPLREFAKDSVRLVKRCHKPDQKEFTKVAFRTAIGFVVMGFVGFFVKLIFIPINNIIVGSG

SEQ ID NO: 2227 - protein, 69 aa, Papaver somniferum
MEAIDSAVDPLREFAKDSVRLVKRCHKPDRKEFTKVAFRTAIGFVVMGFVGFFVKLIFIPINNIIVGSV

SEQ ID NO: 2228 - protein, 69 aa, Solanum tuberosum; identical to SEQ ID NO: 2130

SEQ ID NO: 2229 - protein, 95 aa, Solanum tuberosum
KELISISPQFRSRSRRKNPNFVFRSKMDALDTVFDPLRDFAKDSVRLVKRCHKPDRKEFTKVATRTAIGFVVMGFVGFFVKLIFIPINNIIVGAS

SEQ ID NO: 2230 - protein, 111 aa, Solanum tuberosum
KQWYQRRVAITAGDRSKELISISPQFRSRSRGKNPNFVFRSKMDALDTVFDPLRDFAKDSVRLVKRCHKPDRKEFTKVATRTAIGFVVMGFVGFFVKLIFIPINNIIVGAS

SEQ ID NO: 2231 - protein, 69 aa, Solanum tuberosum; identical to SEQ ID NO: 2130

SEQ ID NO: 2232 - protein, 69 aa, Prunus persica
MDAIDSVVDPLREFSKDSIRLVKRCHKPDRKEFTKVALRTAIGFVVMGFVGFFVKLIFIPINNIIVGSV

SEQ ID NO: 2233 - protein, 69 aa, Prunus persica
MEAIDSVVDPLRVFAKESTRLVKRCHKPDRKEFTKVAIRTAIGFVAMGFVGFFVKLVFIPINNIIVGSV

SEQ ID NO: 2234 - protein, 99 aa, Raphanus sativus
GFKALTFSSFIDSSDFFKEDSDHQNQSIIAMDAIDSVVDPLRDFAKDSIRLVKRCHKPDRKEFTKVAVRTAIGFVVMGFVGFFVKLIFIPINNIIVGAT

SEQ ID NO: 2235 - protein, 69 aa, Raphanus sativus; identical to SEQ ID NO: 2075

SEQ ID NO: 2236 - protein, 69 aa, Raphanus sativus; identical to SEQ ID NO: 2075

SEQ ID NO: 2237 - protein, 96 aa, Raphanus sativus
DNSQLVSLRTNREKEKHKLKEKRKEIAMDAIDSVVDPLRDFAKDSIRLVKRCHKPDRKEFTKVAVRTAIGFVVMGFVGFFVKLIFIPINNIIVGAT

SEQ ID NO: 2238 - protein, 69 aa, Raphanus sativus; identical to SEQ ID NO: 2075

SEQ ID NO: 2239 - protein, 69 aa, Raphanus sativus; identical to SEQ ID NO: 2075

SEQ ID NO: 2240 - protein, 69 aa, Raphanus sativus
MDAIDSAIDPLRDFAKSSIRLVQRCHKPDRKEFTKVAVRTAIGFVVMGFVGFFVKLVFIPINNIIVGSS

SEQ ID NO: 2241 - protein, 69 aa, Raphanus sativus
  misc_feature (6)..(6): Xaa can be any naturally occurring amino acid
  misc_feature (38)..(38): Xaa can be any naturally occurring amino acid
MDAIDXVVDPLRDFAKDSIRLVKRCHKPDRKEFTKVAXRTAIGFVVMGFVGFFVKLIFIPINNIIVGAT

SEQ ID NO: 2242 - protein, 69 aa, Raphanus sativus
  misc_feature (11)..(11): Xaa can be any naturally occurring amino acid
MDAIDSVVDPXRDFAKDSIRLVKRCHKPDRKEFTKVAVRTAIGFVVMGFVGFFVKLIFIPINNIIVGAT

SEQ ID NO: 2243 - protein, 69 aa, Oryza sativa
MDAIDSVVDPLREFAKDSVRLVKRCHKPDRKEFSKVALRTAIGFVVMGFVGFFVKLIFIPINNIIVGSG

SEQ ID NO: 2244 - protein, 89 aa, Rosa hybrid cultivar
PLRLLLYNLRSSSLNSLTQKMDAIDSVVDPLREFSKDSIRLVKRCHKPDRKEFSKVALRTAIGFVVMGFVGFFVKLIFIPINNIIVGSV

SEQ ID NO: 2245 - protein, 92 aa, Rosa hybrid cultivar
SQISNDFVFSLSLALDFSERKSKMDAIDSVVDPLREFAKDSARLVKRCHKPDRKEFSKVALRTAIGFVVMGFVGFFVKLIFIPINNIIVGSV

SEQ ID NO: 2246 - protein, 109 aa, Carthamus tinctorius
GGDVCWRITLLSSSCFLRICIQIPNSLFQIRYLSRSLLDTMDALDSVFEPLREFSKDSYRLVKRCHKPDRKEFSKVAVRTAIGFVVMGFVGFFVKLIFIPINNIIVGSV

SEQ ID NO: 2247 - protein, 69 aa, Carthamus tinctorius; identical to SEQ ID NO: 2134

SEQ ID NO: 2248 - protein, 69 aa, Senecio madagascariensis; identical to SEQ ID NO: 2080

SEQ ID NO: 2249 - protein, 85 aa, Sesamum indicum
LSPHPRSRENSNRCKKMDALDSVFDPLRDFAKDSVRLVKRCHKPDRKEFTKVATRTAIGFVVMGFVGFFVKLIFIPINNIIVGAT

SEQ ID NO: 2250 - protein, 69 aa, Solanum phureja; identical to SEQ ID NO: 2215

SEQ ID NO: 2251 - protein, 69 aa, Solanum phureja; identical to SEQ ID NO: 2130

SEQ ID NO: 2252 - protein, 69 aa, Sorghum bicolor; identical to SEQ ID NO: 2189

SEQ ID NO: 2253 - protein, 69 aa, Sorghum bicolor; identical to SEQ ID NO: 2188

SEQ ID NO: 2254 - protein, 69 aa, Glycine max; identical to SEQ ID NO: 2105

SEQ ID NO: 2255 - protein, 69 aa, Glycine max
MDAIDSVFDPLREFAKDSVRLVKRCHKPDRKEFSKVAVRTAIGFVVMGFVGFFVKIIFIPINNIIVGSG

SEQ ID NO: 2256 - protein, 69 aa, Glycine max; identical to SEQ ID NO: 2105

SEQ ID NO: 2257 - protein, 83 aa, Selaginella moellendorffii
GPRGRIRVLREKEDMEAVDVVVRPMKEFAKDSLRLVKRCHKPDRKEYTKVALRTAAGFVVMGFIGFFVKLIFIPINNIIVGSG

SEQ ID NO: 2258 - protein, 69 aa, Picea glauca; identical to SEQ ID NO: 2220

SEQ ID NO: 2259 - protein, 69 aa, Picea glauca
MEAVDAVVRPLQEFAKDSVRLVKRCHKPDRKEFSKVAFRTAIGFVVMGFVGFFVKLIFIPINNIIVGSG

SEQ ID NO: 2260 - protein, 62 aa, Euphorbia esula
FDPLREFAKDSVRLVKRCHKPDRKEFSKVALRTAIGFVVMGFVGFFVKLIFIPINNIIVGSS

SEQ ID NO: 2261 - protein, 74 aa, Euphorbia esula
KKKIEMDAIDSVFDPLREFAKDSVRLVKRCHKPDRKEFSKVALRTAIGFVVMGFVGFFVKLIFIPINNIIVGSS

SEQ ID NO: 2262 - protein, 94 aa, Fragaria vesca
FVCFYTFSQIFFFSLALKFDHRKEDMDAIDSVVDPLREFSKDSIRLVKRCHKPDRKEFSKVALRTAIGFVVMGFVGFFVKLIFIPINNIIVGSV

SEQ ID NO: 2263 - protein, 69 aa, Fragaria vesca
MDAIDSVVDPLREFAKDSARLVKRCHKPDRKEFSKVALRTAIGFVVMGFVGFFVKLIFIPINNIIVGSV

SEQ ID NO: 2264 - protein, 69 aa, Saccharum officinarum; identical to SEQ ID NO: 2188

SEQ ID NO: 2265 - protein, 69 aa, Saccharum officinarum; identical to SEQ ID NO: 2189

SEQ ID NO: 2266 - protein, 69 aa, Saccharum officinarum; identical to SEQ ID NO: 2189

SEQ ID NO: 2267 - protein, 83 aa, Helianthus annuus
  misc_feature (2)..(2): Xaa can be any naturally occurring amino acid
GXTNSPFKFSEASTMDAIDSVIDPLRDFAKDSARLVKRCHKPDRKEFTKVATRTAIGFVVMGFVGFFVKLIFIPINNIIVGAT

SEQ ID NO: 2268 - protein, 69 aa, Helianthus annuus; identical to SEQ ID NO: 2080

SEQ ID NO: 2269 - protein, 106 aa, Helianthus annuus
GDRITFALCSHCFLRISIQIPNSLCRSSLSLSLDQSTMDALDSVFEPLREFSKDSYRLVKRCHKPDRKEFSKVAVRTAIGFVVMGFVGFFVKLIFIPINNIIVGSV

SEQ ID NO: 2270 - protein, 69 aa, Panicum virgatum; identical to SEQ ID NO: 2189

SEQ ID NO: 2271 - protein, 69 aa, Panicum virgatum; identical to SEQ ID NO: 2188

SEQ ID NO: 2272 - protein, 69 aa, Panicum virgatum; identical to SEQ ID NO: 2189

SEQ ID NO: 2273 - protein, 69 aa, Panicum virgatum
MDAIDSVVDPLRDFAKDSVRLVKRCHKPDRKEFTKVAARTAIGFVVMGFVGFFVKLIFIPINNIIVGSS

SEQ ID NO: 2274 - protein, 69 aa, Tamarix hispida
MDAIDTFADPLRDFARDSVRLVKRCHKPDQKEFTKVAFRTAIGFVVMGFVGFFVKLIFIPINNIIVGAA

SEQ ID NO: 2275 - protein, 69 aa, Tamarix hispida
MDALDSVFDPLRDFSKDSIRLVKRCHKPDQKEFTKVAFRTAIGFVVMGFVGFFVKLIFIPINNIIVGSA

SEQ ID NO: 2276 - protein, 69 aa, Camellia sinensis
MDALDSVFDPLREFAKDSVRLVKRCHKPDRKEFTKVAVRTAIGFVVMGFVGFFVKLIFIPINNIIVGSG

SEQ ID NO: 2277 - protein, 69 aa, Thellungiella halophila; identical to SEQ ID NO: 2075

SEQ ID NO: 2278 - protein, 69 aa, Thellungiella halophila; identical to SEQ ID NO: 2075

SEQ ID NO: 2279 - protein, 77 aa, Nicotiana tabacum
SFRSDLIQMDALDSVFDPLRDFAKDSVRLVKRCHKPDRKEFTKVATRTAIGFVVMGFVGFFVKLIFIPINNIIVGAS

SEQ ID NO: 2280 - protein, 78 aa, Nicotiana tabacum
ERTHYSQTKMDALDSVFDPLRDFAKDSVRLVKRCHKPDRKEFTKVATRTAIGFVVMGFVGFFVKLIFIPINNIIVGAS

SEQ ID NO: 2281 - protein, 88 aa, Nicotiana tabacum
SYSYNPPLPLGETDYSQTKMDALDSVFDPLRDFAKDSVRLVKRCHKPDRKEFTKVATRTAIGFVVMGFVGFFVKLIFIPINNIIVGAS

SEQ ID NO: 2282 - protein, 79 aa, Nicotiana tabacum
PDPHSSFSAKMDALDSVFDPLRDFAKDSVRLVKRCHKPDRKEFTKVATRTAIGFVVMGFVGFFVKLIFIPINNIIVGAS

SEQ ID NO: 2283 - protein, 69 aa, Nicotiana tabacum
MDALDSVFDPLRDFAKDSVRLVKRCHKPDRKEFTKVATRTAIGFVVMGFVGFFVKLVFIPINNIIVGAS

SEQ ID NO: 2284 - protein, 69 aa, Solanum lycopersicum; identical to SEQ ID NO: 2215

SEQ ID NO: 2285 - protein, 1195 aa, Solanum lycopersicum
MVATRRSGSLPSTVKRSASSSDDSSSKRQKVVDNNNNNNNAESSEKPKSPPPTENPKELSSTDPPEFAAVTAPDGETTAVPAAKGEDAPSVSVVATPIAEGATPAIVDKPRSSVTLRKLNQGSETTSPWCRLISEFPQNPTIHVSATNFLIGSSKNAHLPIKQQTVSATLCSIRLTQHEGNWVAVLESRGKGSVQVNGKTVRRSTSCILNSGDELVFGVTGSHAYIFEQLPYELGVKSPPSDVRTSAGKLLRVERRAGDASAVAGASILASLSSLRQDPSRLKPTSQVSGNELPSSPVIHEDELDGLEVDSAAHVGSSSAADVSLTSKIPPLDGNLNDSREAGNMPEEREWNRDSIPASAAGVSLRCAVFKEEIHAAIVDGQQLDVSFDSFPYYLSENTKNVLIAASYIHLKHKEQVKYTSELSTINPRILLSGPAGSEIYQEMLAKALAHYYGAKLLIFDSHSFLGGLSAKEAELLKEGGSAHKISANSKQIPGEPDLSKGNGSSSGQVTNANTLTDPLGLEAHPKMEIGNVPSLAGTSKNTLFKIGDKVRFIGSASGGLYSNSTRGPTFGTRGKIVLPFEDNALSKIGVRFDKPIPDGVNFGGLCDDGHGFFCKASELRLESTGADDLDKLLISTLFEVVFSESRKSPFILFMKDAEKSMAGSSESYTTFKNRLEKLPGNIIVIGSHAHTDNRKEKSHPGGLLFTKFGSNQTALLDLAFPDSFGKLHDRGKEVTKTTKLLTKLFPNKVTIHMPQDEALLSDWKQQLDRDADTLKMKGNLNSLRTVLNRNGLDCDGLDTLCIKDQTFSVESAEKVVGWALSHHLMQNPDANPDVRLVLSPLSIQYGLEILQAMQNESKSLKKSLKDIVTENEFEKRLLADVIPPSDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVVFVDEVDSMLGRRENPGEHEAMRKMKNEFMVNWDGLRTKDTERVLVLAATNRPFDLDEAVIRRLPRRLMVNLPDAPNRAKILKVILAKEDLSPDVDLDAVASMTDGYSGSDLKNLCVTAAYQPIREILEKEKKEHAAAMAEGRPTPTPCGGADIRPLNMDDFKNAHERVCASVSSESINMTELLQWNELYGEGGSRRKKSLSYFM

SEQ ID NO: 2286 - protein, 76 aa, Triphysaria pusilla
LILRGKSMDSLDSVFDPLRDFAKDSVRLVKRCHKPDRKEFTKVATRTAIGFVVMGFVGFFVKLIFIPINNIIVGAT

SEQ ID NO: 2287 - protein, 69 aa, Juglans hindsii x Juglans regia
MDAVDSVVDPLREFAKDSVRLVKRCHKPDRKEFTKVAFRTAIGFVVMGFVGFFVKLIFIPINNIIVGSG

SEQ ID NO: 2288 - protein, 122 aa, Triticum aestivum
QFTLFYREKVYKRSHPSAKPTRTNPNSIRPSASTLPLTRATSSPSARRSRPPAMDAVDSVVDPLREFAKDSVRLVKRCHKPDRKEFTKVAARTAIGFVVMGFVGFFVKLIFIPINNIIVGSG

SEQ ID NO: 2289 - protein, 113 aa, Triticum aestivum
AIRETHPHKSKQHSPVGIPFPFPSRARPRRRRRLGDLAFPPAAAMDAVDSVVDPLREFAKDSVRLVKRCHKPDRKEFTKVAARTAIGFVVMGFVGFFVKLIFIPINNIIVGSG

SEQ ID NO: 2290 - protein, 90 aa, Triticum aestivum
PPHSASHLSGEISLLPAPQPAMDAVDSVVDPLREFAKDSVRLVKRCHKPDRKEFTKVAIRTAIGFVVMGFVGFFVKLIFIPINNIIVGSG

SEQ ID NO: 2291 - protein, 95 aa, Triticum aestivum
TRANAPPHSASHLSGEISLLPAPQPAMDAVDSVVDPLREFAKDSVRLVKRCHKPDRKEFTKVAIRTAIGFVVMGFVGFFVKLIFIPINNIIVGSG

SEQ ID NO: 2292 - protein, 112 aa, Triticum aestivum
AIRETHPHKSKAAFPRRLPPSPHARDLVVVAGSEISPRPPAAAMDAVDSVVDPLREFAKDSVRLVKRCHKPDRKEFTKVAARTAIGFVVMGFVGFFVKLIFIPINNIIVGSG

SEQ ID NO: 2293 - protein, 104 aa, Triticum aestivum
RHEGRSTSSDTSKPTSTFCSHLSGEISLLPAPQPAMDAVDSVVDPLREFAKDSVRLVKRCHKPDRKEFTKVAIRTAIGFVVMGFVGFFVKLIFIPINNIIVGSG

SEQ ID NO: 2294 - protein, 95 aa, Triticum aestivum
TSKRTSTFCLPPLRRDLSLRPAPQPAMDAVDSVVDPLREFAKDSVRLVKRCHKPDRKEFTKVAIRTAIGFVVMGFVGFFVKLIFIPINNIIVGSG

SEQ ID NO: 2295 - protein, 131 aa, Triticum aestivum
  misc_feature (94)..(94): Xaa can be any naturally occurring amino acid
  misc_feature (96)..(96): Xaa can be any naturally occurring amino acid
  misc_feature (122)..(122): Xaa can be any naturally occurring amino acid
KTASSHQLPSTFVSRSRPVAMDAIDSVVDPLRDFAKDSVRLVKRCHKPDRKEFTKVAARTAIGFRPSWVPSASSVNSSSSPSTTHRRSRLSLQXYXATSMGSNAILWGAIDNEILAFRIYVXEFSVRVFPM

SEQ ID NO: 2296 - protein, 112 aa, Triticum aestivum
  misc_feature (72)..(72): Xaa can be any naturally occurring amino acid
  misc_feature (108)..(108): Xaa can be any naturally occurring amino acid
VQASEEHPSRSLPPRAAMDAVDSVVDPLREFAKDSIRLVKRCHKPDRKEFTKVAARTAIGFRRHGIRRFFVXSSSSLSTTSSVGPVIRKPQANGLQEWDNGLTTLGGXPFQL

SEQ ID NO: 2297 - protein, 80 aa, Triticum aestivum
STFVSRSRPVAMDAIDSVVDPLRDFAKDSVRLVKRCHKPDRKEFTKVAARTAIGFVVMGFVGFFVKLIFIPINNIIVGSG

SEQ ID NO: 2298 - protein, 104 aa, Triticum aestivum
KSQAALPRRVPPSPYAGDLVFVPGSEILPCPPATTMEAVDSVVDPLREFPKDSVPLVKRFHKPGPKEFTKVAARTAIGFVVMGILGGFVKLIFIPINKIIVGSG

SEQ ID NO: 2299 - protein, 353 aa, Brachypodium distachyon
MRPAAAAAASVLHAPRRALGGAASMVAARCGASPSVAAAATAYGEETAVFHHVSFVKEIAATDPPEHLNSLLSVLQARGEKIVSPGAKRGLIPLVVPLSESPEGNLTSLLRWPTAPRGMEMPVVEVRNHGLWLLAKNVNQYIHRILVEADASAENGDDLWSAVGEAGINLYKKGDFKEAQLADLDVYLLKKVGLFPDIIERKASRHLEIGDQVSALITGEFYTRDQFPGFGRPFVFNSHILKRVGRTSEAKESARVALKSPWWSLGCRYEEAAELAGWEDEQIEFIREKVTEEGKRDDLKKGKAPEQVVLDEAAFLMDLATVDGNWDDVVDRIAECYREAGIHDIAKFIAYRE

SEQ ID NO: 2300 - protein, 344 aa, Zea mays
MKPPVSRAAFASVLIGPRTLGASLVAARCASSSAAAAVTAYDHASFVKEIAATDPPEHLNSLLNVLQARGEKIVSPGAKRGLIPCVVPLSESPAGDLTSLLRWPTAPTGMEMPVVEVRKHGLWLLAKNVKQYIHRILVEADFSAGTGDDLWAAVGEAGKNLYAKGEFKESQVADLDVYLLKKVGLFPDVIERKTLRHLEKGDNVSALITGEFYTRDQFPGFGRPFVFNAEIFKRVGRTSEAKDSARVALKSPWWTLGCSYEEAAELAGWEDEQLEFIREKVTEEGKREDLKRGKAPEQVILDEAAFLMDLASVDGNWDEVVDRIAECYREAGLHDIANFIAYRE

SEQ ID NO: 2301 - protein, 347 aa, Sorghum bicolor
MRPPVSRAAFASVLMGPRALGASLVAARCAASSPAAAATAAVTAYDHASFVNEIAVTSPPEHLNSLLNVLQARGEKIVSPGAKRGLIPCVVPLSESPAGNLTSLLRWPTAPTGMEMPVVEVRKHGLWLLAKNVKQYIHRILVEADINADTGDDLWTAVGEAGNLYAKGDFKESQLPDLDVYLLKKVGLFPDVIERKTLRHLEKGDNVSALITGEFYSRDQFPGFGRPFVFNAEILKRVGRTSEAKDSARVALKSPWWTLGCSYEEAAELAGWEDEQLEFIREKVTEEGKREDLKKGKAPEQVVLDEAAFLMDLASVDGNWDEVVDRIAECYREAGLHDIANFIAYRE

SEQ ID NO: 2302 - protein, 120 aa, Panicum virgatum
  misc_feature (70)..(70): Xaa can be any naturally occurring amino acid
  misc_feature (75)..(75): Xaa can be any naturally occurring amino acid
  misc_feature (97)..(97): Xaa can be any naturally occurring amino acid
  misc_feature (108)..(108): Xaa can be any naturally occurring amino acid
  misc_feature (110)..(111): Xaa can be any naturally occurring amino acid
MRPPVSRAAFASVLFGRRASPVAARCASSSAASPAAAAAVTAAYHHASFVKEIAATDPPEHLDSLLNVLXARGEXIVSPGAKTGLIPVVVPLSESPXGNLTSLLRWPXAXXDGDACSGSS

SEQ ID NO: 2303 - protein, 307 aa, Aquilegia formosa
MKSTGRFFTIGLVSAWYSSNIGVLLLNKYLLSNYGFKYPIFLTMCHMTACSLFSYIAIAWMKMVPMQTIRSRVQFFKISALSLIFCASVVSGNVSLRYLPVSFNQAVGATTPFFTAVFAYIMTVKREAWLTYITLIPVVTGVVIASGGEPSFHLFGFIMCVGATAARALKSVLQGILLSSEGEKLNSMNLLLYMAPIAVVFLLPATLIMEENVVGITLALAREDFKIIWYLLFNSALAYFVNLTNFLVTKHTSALTLQVLGNAKGAVAVVVSISIFRNPVSVTGMLGYTLTVIGVILYSEAKKRSSK

SEQ ID NO: 2304 - protein, 308 aa, arabidopsis lyrata
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGGEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 2305 - protein, 306 aa, arabidopsis lyrata
MATNGRFFTIGLVTSWYSSNIGVLLLNKYLLSNYGFKYPIFLTMCHMTACSLLSYVAIAWLKMVPMQTIRSRVQFFKISALSLVFCVSVVFGNISLRFLPVSFNQAIGATTPFFTAVFAYLMTLKKEAWLTYFTLVPVVTGVVIASGGEPSFHLFGFLMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVCGVILYSEAKKRSK

SEQ ID NO: 2306 - protein, 308 aa, Arabidopsis thaliana
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGSEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 2307 - protein, 307 aa, Arabidopsis thaliana
MATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 2308 - protein, 305 aa, Artemisia annua
PTSRLFTIGLVTSWYSSNIGVLLLNKYLLSNYGFKYPIFLTMCHMTACALLSYIGIAWLKMVPMQTIRSRVQFMKISALSAIFCASVVSGNVSLRYLPVSFNQAIGATTPFFTAVFAYLMTLKKEAWLVYLTLVPVVTGVVIASGGEPSFHLFGFIMCIGATAARALKTVVQGILLSSEGEKLNSMNLLLYMAPIAVVLLLPATLYMEENVVGITIALARQDFGIVWLLLFNSARAYFVNLTNFLVTKHTSALTLQVLGNAKGAVAVVVSILIFRNPVSVTGMAGYTLTVIGVILYSEAKKRSNK

SEQ ID NO: 2309 - protein, 322 aa, Brachypodium distachyon
MTAKGGASPSPGGAGAAANGRFFTVGLVTAWYSSNIGVLLLNKYLLSNYGFKYPIFLTMCHMSACALLSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLAYFVNLTNFLVTKHTSALTLQVLGNAKGAVAVVVSILIFKNPVSVTGMLGYTLTVIGVILYSESKKRSKP

SEQ ID NO: 2310 - protein, 306 aa, Brassica napus
MAANGRFFTIGLVASWYSSNIGVLLLNKYLLSNYGFKYPIFLTMCHMTACSLLSYVAIAWMKMVPMQTVRSRVQFLKIAALSLVFCVSVVFGNISLRFLPVSFNQAIGATTPFFTAVFAYLITLKREAWLTYVTLVPVVTGVVIASGGEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVIGVILYSEAKKRSK

SEQ ID NO: 2311 - protein, 306 aa, Manihot esculenta
MKTPSRLFTIGLVSSWYSSNIGVLLLNKYLLSNYGFKYPIFLTMCHMTACSLLSYIAIAWMKMVPMQTIRSRLQFFKIAALSLVFCVSVVFGNISLRFLPVSFNQAVGATTPFFTAVFAYLMTLKREAWLTYVTLIPVVTGVIIASGGEPSFHLFGFIMCISATAARALKSVLQGILLSSEGEKLNSMNLLLYMAPIAVVFLLPATLIMEKNVVGITLALARDDVKIVWYLLFNSALAYFVNLTNFLVTKHTSALTLQVLGNAKGAVAVVVSILIFRNPVSVTGMLGYTLTVFGVILYSEAKKRSK

SEQ ID NO: 2312 - protein, 306 aa, Ricinus communis
MKPTSRFFTIGLVTSWYSSNIGVLLLNKYLLSNYGFKYPIFLTMCHMTACSLLSYVAIAWMKMVPMQTIRSRLQFLKISALSLVFCVSVVFGNISLRFLPVSFNQAIGATTPFFTAVFAYLMTFKREAWLTYVTLVPVVTGVIIASGGEPSFHLFGFIMCIAATAARALKSVLQGILLSSEGEKLNSMNLLLYMAPIAVVFLLPATLIMEDNVVGITLALARDNIKIIWYLLFNSALAYFVNLTNFLVTKHTSALTLQVLGNAKGAVAVVVSILIFRNPVSVTGMLGYSLTVMGVILYSEAKKRSK

SEQ ID NO: 2313 - protein, 308 aa, Centaurea maculosa
MKGGGTGQWFTIGLVSSWYASNIGVLLLNKYLLSNYGFKYPIFLTMCHMTACSLLSYIAIVWMKMVPLQMVRSRAQFLKISVLSLVFCASVVSGNVSLRYLPVSFTQAVGATTPFFTAVFAYVMTVKREAWLTYLTLLPVVTGVVIASGGEPSFHLFGFIMCIGATAARALKSVLQGILLSSEGEKLNSMNLLLYMAPVAVVILLPATLFMEENVVGITIALARKDVNIVWYLLFNSGMAYCVNLTNFLVTKHTSALTLQVLGNAKGAVAVVVSILIFKNPVSVTGMLGYLLTVLGVILYSEAKKRTK

SEQ ID NO: 2314 - protein, 307 aa, Cichorium intybus
MKGGTGQWFTIGLVSSWYASNIGVLLLNKYLLSNYGFKYPIFLTMCHMTACSLLSYIAIVWMKMVPLQHVRSRGQFIKISVLSLVFCASVVSGNVSLRYLPVSFTQAVGATTPFFTAVFAYIMTVKREAWLTYLTLVPVVTGVVIASGGEPSFHLFGFIMCIGATAARALKSVLQGILLSSEGEKLNSMNLLLYMAPVAVVILLPATLFMEDNVVGITIALARKDVNIVWYLLFNSAMAYCVNLTNFLVTKHTSALTLQVLGNAKGAAAVVVSILIFKNPVSVTGMLGYLLTVFGVILYSEAKKRTK

SEQ ID NO: 2315 - protein, 306 aa, Gossypium hirsutum
MKNQSKMFTIGLVSAWYSSNIGVLLLNKYLLSNYGFKYPIFLTMCHMTACSLLSYIAIAWMKMVPMQTIRSRVQFFKITTLSLVFCVSVVFGNISLRYLPVSFNQAVGATTPFFTAVFAYLMTLKREGWLTYITLVPVVTGVIIASGGEPSFHLFGFIMCISATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMLGYTLTVFGVILYSEAKKRSK

SEQ ID NO: 2316 - protein, 306 aa, cucumber
MKGSSRFFTIGLVTSWYSSNIGVLLLNKYLLSNYGFKYPIFLTMCHMTACSLLSYVAIAWLKMVPMQTIRSRIQFLKIAALSFVFCISVVFGNISLRYLPVSFNQAVGATTPFFTAVFAYLMTMKREAWLTYVTLIPVVTGVIIASGGEPSFHLFGFIICVAATAARALKSVLQGILLSSEGEKLNSMNLLLYMAPIAVVFLLPAALFMEENVVGITLALARDDKKIIWYLLFNSSLAYFVNLTNFLVTKHTSALTLQVLGNAKGAVAVVISILIFRNPVSVTGMLGYALTVMGVILYSESKKRSK

SEQ ID NO: 2317 - protein, 311 aa, Zingiber officinale
MSPALANGRFFTVGLVTAWYSSNIGVLLLNKYLLSNYGFKYPIFLTMCHMTACSLLSYVAIAWLKIVPMQTIRSRVQFLKIAALSLVFCGSVVSGNVSLRYLPVSFNQAVGATTPFFTAIFAYLMTLRRESWLTYITLVPVVTGVIIASGGEPSFHLFGFIMCIGATAARALKSVLQGILMSSEGEKLNSMNLLLYMAPIAVVFLLPATIIMEENVIGITLALARQDFKIIWYLLFNSSLAYFVNLTNFLVTKHTSALTLQVLGNAKGAVAVVISILIFRNPVSVTGMAGYSLTVIGVILYSESKKRNKGS

SEQ ID NO: 2318 - protein, 306 aa, Mesembryanthemum crystallinum
MKNTSRFFTIGLVTSWYSSNIGVLLLNKYLLSNYGFKYPIFLTMCHMTACSLLSYIAIAWMKMVPMQTIRSRVQFFKITALSLIFCASVVSGNISLKYLPVSFNQAIGATTPFFTAVFAYLMTFKREAWLTYVTLVPVVTGVIIASGGEPSFHLFGFIMCIGATAARALKSVLQGILLSSEGEKLNSMNLLLYMAPIAVVFLLPATLFMEENVVGITLALAREDVKIVWYLIFNSALAYFVNLTNFLVTKHTSALTLQVLGNAKGAVAVVVSIMIFKNPVSVTGMLGYSLTVLGVILYSEAKKRSK

SEQ ID NO: 2319 - protein, 192 aa, Lactuca sativa
  misc_feature (190)..(190): Xaa can be any naturally occurring amino acid
MSAIKSPSPTRFFTIGLVTSWYSSNIGVLLLNKYLLSNYGFKYPIFLTMCHMTACALLSYIAIAWLKMVPMQTIRSRVQFFKISALSLIFCGSVVSGNISLRYLPVSFNQAIGATTPFFTAVFAYLMTLKKEAWLTYITLIPVVTGVIIASGGEPSFHLFGFIMCIGATAARALKQLFKGSCFLLKGRSXTP

SEQ ID NO: 2320 - protein, 322 aa, Leymus cinereus x Leymus triticoides
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 2321 - protein, 324 aa, Zea mays
MAAKGGATPSPGGTGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 2322 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 2323 - protein, 306 aa, Cucumis melo
  misc_feature (226)..(226): Xaa can be any naturally occurring amino acid
  misc_feature (271)..(271): Xaa can be any naturally occurring amino acid
  misc_feature (283)..(283): Xaa can be any naturally occurring amino acid
MKGSSRFFTIGLVTSWYSSNIGVLLLNKYLLSNYGFKYPIFLTMCHMTACSLLSYVAIAWLKMVPMQTIRSRIQFLKIAALSFVFCISVVFGNISLRYLPVSFNQAVGATTPFFTAVFAYLMTMKREAWLTYVTLIPVVTGVIIASGGEPSFHLFGFIICVAATAARALKSVLQGILLSSEGEKLNSMNLLLYMAPIAVVFLLPAALFMEENVVGITLALARDDKXIIWYLLFNSSLAYFVNLTNFLVTKHTSALTLQVLGNAKGAVAVVXSILIFRNPVSVXGMLGYALTVMGVILYSESKKRSK

SEQ ID NO: 2324 - protein, 129 aa, Mimulus guttatus
MKSTGRFFTIGLVTSWYSSNIGVLLLNKYLLSNYGFKYPIFLTMCHMTACSLLSYIAIAWMKMVPMQTIRSRVQFMKISALSLIFCASVVSGNISLKYLPVSFNQAIGATTPFFTAVFAYLMTFKRRPG

SEQ ID NO: 2325 - protein, 308 aa, Mimulus guttatus
MKSSGRLFTIGLVASWYSSNIGVLLLNKYLLSNYGFKYPIFLTMCHMMACSLLSYIAIAWLKMVPMQTIRSRVQFMKISALSLIFCASVVSGNISLKYLPVSFNQAIGATTPFFTAVFAYFMTLKKEAWLTYMTLIPVVTGVIIASGGEPSFHLFGFLMCIGATAARALKSVLQGILLSSEGEKLNSMNLLLYMAPIAVVVLLPATLFMEENVVGITLALAREDIRIIWLLLFNSALAYFVNLTNFLVTKHTSALTLQVLGNAKGAVAVVISILIFRNPVSVTGMLGYTLTVFGVILYSEAKKRTTSK

SEQ ID NO: 2326 - protein, 308 aa, Carica papaya
MKGATNSRFFTIGLVTSWYSSNIGVLLLNKYLLSNYGFKYPIFLTMCHMTACSLLSYIAIAWMKMVPMQTIRSRVQFFKISALSLVFCVSVVFGNISLRFLPVSFNQAIGATTPFFTAVFAYLMTLKREAWLTYLTLVPVVTGVIIASGGEPSFHLFGFIMCIAATAARALKSVLQGILLSSEGEKLNSMNLLLYMAPIAVVFLLPATLIMEENVVGIALALARDDVKIIWYLLFNSALAYFVNLTNFLVTKHTSALTLQVLGNAKGAVAVVVSILIFRNPVSVTGMLGYTLTVIGVILYSEAKKRSK

SEQ ID NO: 2327 - protein, 187 aa, Raphanus sativus
  misc_feature (14)..(14): Xaa can be any naturally occurring amino acid
  misc_feature (24)..(24): Xaa can be any naturally occurring amino acid
  misc_feature (81)..(81): Xaa can be any naturally occurring amino acid
MKTADPNGRFFTIXLVASWYSSNXGVLLLNKYLLSNYGFKYPIFLTMCHMTACSLLSYVAIAWLKMVPMQTVRSRVQLLKXAALSLVFCVSVVFGNVSLRFLPVSFNQAVGATTPFFTAVFAYMMTMKREAWLTYVTLLPVVTGVVIASGGEPSFHLFGFIMCIAATAARALKSVLQGILLSSEGRS

SEQ ID NO: 2328 - protein, 306 aa, Solanum phureja
MKSSGQFFTIGLVTAWYSSNIGVLLLNKYLLSNYGFKYPIFLTMCHMTACSLLSYIAIAWMKIVPMQTIRSRVQFMKISALSLIFCTSVVSGNISLRYLPVSFNQAIGATTPFFTAVFAYLMTFKREAWLTYVTLIPVVTGVVIASGGEPSFHLFGFIICIGATAARALKSVLQGILLSSEGEKLNSMNLLLYMAPIAVVFLLPATLMMEENVVGITLALARDDSRIIWLLLFNSALAYFVNLTNFLVTKHTSALTLQVLGNAKGAVAVVISILIFRNPVSVTGMLGYALTVFGVILYSEAKKRSK

SEQ ID NO: 2329 - protein, 325 aa, Sorghum bicolor
MTAKGGATPSPGGAGGAAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSEGEKLNSMNLLLYMAPIAVIFLLPATIFMEDNVVGITIQLAKKDFTIVWLLLFNSCLAYFVNLTNFLVTKHTSALTLQVLGNAKGAVAVVVSIMIFRNPVSITGMLGYTLTVIGVILYSESKKRSNKP

SEQ ID NO: 2330 - protein, 317 aa, Sorghum bicolor
MTGKDAAAGGGGGKGRLFTVGLVTAWYSSNIGVLLLNKYLLSNYGFKYPIFLTMCHMSACSLFSYAAIAWLRIVPMQLPRSRLQLAKIAALSLVFCASVVSGNISLRYLPVSFNQAVGATTPFFTAVFAYLMTVKRESFLTYLALVPVVTGVIIASGGEPSFNLFGFIMCVGATAARALKTVLQGILMSSDGEKINSMNLLMYMAPIAVLLLVPATIFMEDNVVVITIQLARKDINIIWYLLFNSSLAYFVNLTNFLVTKHTSALTLQVLGNAKGAVAVVISILIFRNPVSITGMLGYTLTVIGVLLYSEAKKRTKQ

SEQ ID NO: 2331 - protein, 306 aa, Glycine max
MKSSSRLFTIGLVSAWYSSNIGVLLLNKYLLSNYGFKYPIFLTMCHMTACSLFSYVAIAWLKMVPMQTIRSRLQFLKIAALSLVFCVSVVFGNVSLRYLPVSFNQAVGATTPFFTAVFAYIMTFKREAWLTYLTLVPVVTGVVIASGGEPSFHLFGFIVCIAATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMMGYSLTVLGVVLYSEAKKRSK

SEQ ID NO: 2332 - protein, 321 aa, Selaginella moellendorffii
MEKEKLLRSGSLASQAMAPGSVFTVGLIGAWYSSNIGVLLLNKYLLSNYGFKYPIFLTMCHMTACALFSYIGIAWLKLVPMQAIRSRTQFVKISALSIIFCASVVSGNISLRYLPVSFNQAVGATTPFFTAVFAYLMTLKREAWVTYLTLVPVVTGVIIASGGEPSFHLYGFIMCVSATAARALKSVLQGILLSSEGEKLNSMNLLLYMAPIAVVLLLPATLIMEPNVVGITIALARTNFSIIGLLLVNSATAYFVNLTNFLVTKHTSALTLQVLGNAKGAVAVVVSILLFRNPVSVVGMAGYTLTVFGVILYSESKRRLK

SEQ ID NO: 2333 - protein, 314 aa, Saccharum officinarum
  misc_feature (268)..(268): Xaa can be any naturally occurring amino acid
MTGKDAGGGGKGRLFTVGLVTAWYSSNIGVLLLNKYLLSNYGFKYPIFLTMCHMSACSLFSYAAIAWLRIVPMQLPRSRQQLAKIAALSLVFCASVVSGNISLRYLPVSFNQAVGATTPFFTAVFAYLMTVKRESFLTYLALVPVVTGVIIASGGEPSFNLFGFIMCVGATAARALKTVLQGILMSSDGEKINSMNLLMYMAPIAVLLLVPATIFMEDNVVAITIQLAKKDINIIWYLLFNSSLAYFVNLTNFLVTKHTSALTLQVLXNAKGAVAVVISILIFRNPVSITGMLGYTLTVIGVLLYSEAKKRTKQ

SEQ ID NO: 2334 - protein, 259 aa, Saccharum officinarum
  misc_feature (122)..(122): Xaa can be any naturally occurring amino acid
  misc_feature (170)..(170): Xaa can be any naturally occurring amino acid
  misc_feature (176)..(176): Xaa can be any naturally occurring amino acid
  misc_feature (180)..(180): Xaa can be any naturally occurring amino acid
  misc_feature (196)..(196): Xaa can be any naturally occurring amino acid
  misc_feature (220)..(220): Xaa can be any naturally occurring amino acid
  misc_feature (230)..(230): Xaa can be any naturally occurring amino acid
MTAKGGVTPSPGGAGGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNXAVGATTPFFTAVFAYIMTVKRESWVTYLTLVPVVTGVIIASGGEPSFXLFGFIXCIGXTAARALKTVLQGILLXSEGEKLNSMNLLLYMAPIAVISCXLQLSLWRIMXSALQFSLQRRISRLSGCYCSILAWHILSI

SEQ ID NO: 2335 - protein, 315 aa, Helianthus annuus
MSAIKPATSSRFFTIGLVTSWYSSNIGVLLLNKYLLSNYGFKYPIFLTMCHMTACALLSYIGIAWLKMVPMQTIRSRVQFLKISALSFIFCASVVSGNISLRYLPVSFNQAIGATTPFFTAVFAYLITLKKEAWLVYVTLVPVVTGVIIASGGEPSFHLFGFIMCIGATAARALKTVVQGILLSSEGEKLNSMNLLLYMAPIAVVLLLPATLYMEENVVGITIALARQDFGIVWLLLFNSALAYFVNLTNFLVTKHTSALTLQVLGNAKGAVAVVVSILIFRNPVSITGMAGYTLTVIGVALYSEAKSVATSDWL

SEQ ID NO: 2336 - protein, 324 aa, Panicum virgatum
MTAKGGAAPSPGGTGAAAGTGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMIVKRESWVTYLTLVPVVTGVIIASGGEPSFHLFGFIMCIGATAARALKTVLQGILLSSEGEKLNSMNLLLYMAPIAVILLLPATIFMEDNVVGVTIQLAKKDFTIVWLLLFNSCLAYFVNLTNFLVTKHTSALTLQVLGNAKGAVAVVVSIMIFRNPVSITGMLGYTLTVIGVILYSESKKRSNKP

SEQ ID NO: 2337 - protein, 306 aa, Solanum lycopersicum
MKSSGQFFTIGLVTAWYSSNIGVLLLNKYLLSNYGFKYPIFLTMCHMTACSLLSYIAIAWMKMVPMQTIRSRVQFMKISALSLIFCTSVVSGNISLRYLPVSFNQAIGATTPFFTAVFAYLMTFKREAWLTYVTLIPVVTGVIIASGGEPSFHLFGFIICIGATAARALKSVLQGILLSSEGEKLNSMNLLLYMAPIAVVFLLPATLVMEENVVGITLALARDDSRIIWLLLFNSALAYFVNLTNFLVTKHTSALTLQVLGNAKGAVAVVISILIFRNPVSVTGMLGYALTVFGVILYSEAKKRSK

SEQ ID NO: 2338 - protein, 366 aa, Triticum aestivum
QAHTPPLRAQTHHQFNRDPTHPVILTTGASPLLRSTRARARPAAMTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 2339 - protein, 171 aa, Brachypodium distachyon
MAPTTVVAAPATGAVASSVDVGKAAAPGRSVGLGLPALPPLPGLAAHAQPRVASFCKRFARNVVAMAAGEPAAPLADNAELTEFINALKQEWDRVEDKYAVTTLAVAATLGMWSAGGVVSAIDRLPVVPGLMEAVGIGYSGWFAYKNLLFKPDRKAFFAKVRNIYEDIISG

SEQ ID NO: 2340 - protein, 168 aa, Pseudoroegneria spicata
MAPTVATPATGAVASPIASDVGKAARSVGLGLPALPPLPGLASHGQPRVASFCKRLARNVVSMAAGEPAAPLADNAELTEFFNSLKQEWDRVEDKYAVTTLAVAATLGMWSAGGVVSAIDRLPVVPGLMEVVGIGYSGWFAYKNLIFKPDRKAFFAKVRNIYEDIISG

SEQ ID NO: 2341 - protein, 168 aa, Triticum aestivum
MAPTVASPATGAVASPIASDLGKAARSVGLGLPALPPLPGLASHGQPRVASFCKRLARNVVSMAAGEPAAPLADNAELTEFFNGLKQEWDRVEDKYAVTTLAVAATLGMWSAGGVVSAIDRLPVVPGLMEVVGIGYSGWFAYKNLLFKPDRKAFFAKVRNIYEDIISG

SEQ ID NO: 2342 - protein, 168 aa, Triticum aestivum
MAPTVASPATGAVPSPIASDLGKAARSVGLGLPALPPLPGLASHGQPRVASFCKRLARNVVSMAAGEPAAPLADNAELTEFFNGLKQEWDRVEDKYAVTTLAVAATLGMWSAGGVVSAIDRLPVVPGLMEVVGIGYSGWFAYKNLLFKPDRKAFFAKVRNIYEDIISG

SEQ ID NO: 2343 - protein, 164 aa, Hordeum vulgare
MALRLWASSAANALKISSSGARAAAPAYSISRYFSTVIDGLKYTSSHEWVKNDGSVATIGISDHAQGHLGEVVFVELPEAGTKVSQGGAFGNVESVKATSDVNSPISGEVVEVNSKLSEAPGLINSSPYEEGWMIKVKPSSPAELEGLLDSAKYTKHCEEEDAH

SEQ ID NO: 2344 - protein, 164 aa, Brachypodium distachyon
MALRLWASSAANALKISSSGARAAAPAYSISRYFSTVLDGLKYSSSHEWVKNEGTVATIGISDHAQGHLGEVVFVELPEAGTKVTQGGAFGNVESVKATSDVNSPISGEVVEVNEKLSGTPGLINTSPYEDGWMIKVKPSSPSELDALLDPAKYTKHCEEEDAH

SEQ ID NO: 2345 - protein, 164 aa, Festuca arundinacea
MALRLWASSAANALKISSSGAKAAAPAYSISRYFSTVLDGLKYTSSHEWVKNDGSVATIGISDHAQGHLGEVVFVELPEAGTKVSQGGAFGNVESVKATSDVNSPISGEVVEVNAKLSETPGLINSSPYEDGWMIKVKPSSPTELDALLDSAKYTKHCEEEDAH

SEQ ID NO: 2346 - protein, 149 aa, Lolium multiflorum
MALRLWASSAANALKISSSGARAAAPAYSISRYFSTVLDGLKYTSSHEWVKNDGAVATIGISDHAQSHLGEVVFVELPEAGTKVSQGGAFGNVESVKATSDVNSPISGEVVEVNAKLSETPGLINSSPYEDGWMIKVKPSSPTELDALL

SEQ ID NO: 2347 - protein, 164 aa, Zea mays
MALRMWASSAANALKLSAGGAGARAAAFSISRFFSTVHDGLKYTQSHEWVKTTGDVATVGITDHAQGHLGEVVFVELPEPGTKVAAGGPFGNVESVKATSDVNSPISGEVVEVNAKLSETPGLINTSPYEDGWMIKVKPSSPGEADALLDAAKYTKHCEEEDAH

SEQ ID NO: 2348 - protein, 147 aa, Zea mays
MKYTSSHEWVKNYGSVATIGISDHAQGHLGEVVFEELPEAGNKVSQGGPFGNVESVKATNERQLAHLQRGQLRQLKAVRDPRPDQLEPVRGWVDDQGEPKQPGGAGGPARLGQVHQTLPGRGPPLVLLARLSFLFVGTISTTLVYNN

SEQ ID NO: 2349 - protein, 164 aa, Pseudoroegneria spicata
MALRLWASSAANALKISSSGARAAAPAYSISRYFSTVLDGLKYTSSHEWVKNDGSVATIGISDHAQGHLGEVVFVELPEAGTKVSQGGAFGNVESVKATSDVNSPISGEVVEVNSKLSETPGLINSSPYEEGWMIKVKPSSPAELEGLLDSAKYTKHCEEEDAH

SEQ ID NO: 2350 - protein, 95 aa, Secale cereale
MALRLWASSAANALKISSSGARAAAPAYSISRYFSTVLDGLKYTSSHEWVKNDGSVATIGISDHAQGHLGEVVFVELPETGTKVSQGGPSATWRV

SEQ ID NO: 2351 - protein, 164 aa, Triticum aestivum
MALRLWASSAANALKISSSGARAAAPAYSISRYFSTVIDGLKYTSSHEWVKNDGSVATIGISDHAQGHLGEVVFVELPEAGTKVSQGGAFGNVESVKATSDVNSPISGEVVEVNSKLSETPGLINSSPYEEGWMIKVKPSSPAELEGLLDSAKYTKHCEEEDAH

SEQ ID NO: 2352 - protein, 164 aa, Triticum aestivum
MALRLWASSAANALKISSSGARAAAPAYSISRYFSTVIDGLKYTSSHEWVKNDGSVATIGISDHAQGHLGEVVFVELPETGTKVSQGGAFGNVESVKATSDVNSPISGEVVEVNSKLSETPGLINSSPYEEGWMIKVKPSSPAELEGLLDSAKYTKHCEEEDAH

SEQ ID NO: 2353 - protein, 164 aa, Triticum aestivum
MALRLWASSAANALKISSSGARAAAPAYSISRYFSTVIDGLKYTSSHEWVKNDGSVATIGISDHAQGHLGEVVFVELPEAGTKVSQGGAFGNVESVKATSDVNSPISGEVVDVNSKLSETPGLINSSPYEDGWMIKVKPSSPAELEGLLDSAKYTKHCEEEDAH

SEQ ID NO: 2354 - protein, 130 aa, Hordeum vulgare
MVLMQADPFLSELTNMYERTTEKGSVWVTMKRSSMKCKARLKKMADKGELVEYRCLVRASDGKRNISTSLSAKEYLKFQASYSLVLKAHMHALKKRERKDRKKTVEAEKIPEKEPKKQKKSSSKKSAGSK

SEQ ID NO: 2355 - protein, 131 aa, Saccharum officinarum
MVVLQPDRFLSELTSMYERSTEKGSVWVTMKRSTLKSKAQLQKMEKKGQEVEHRCLVRASDGKKSISTSVSLKEYSKFQASYATVLKAHMHALKKRERKDKKKAADAEKAIETAPKKQKKASSKKSSGSKS

SEQ ID NO: 2356 - protein, 130 aa, Triticum aestivum
MVLMQADPFLSELTNMYERSTEKGSVWVTMKRSSMKCQARLKKMASKGEPVEYRCLVRASDGKRNISTSLSAKEYLKFQASYALVLKAHMHALKKRERKDRKKTVEAEKIPEKEPKKQKKSSSKKSAGSK

SEQ ID NO: 2357 - protein, 130 aa, Triticum aestivum; identical to SEQ ID NO: 2356

SEQ ID NO: 2358 - protein, 130 aa, Triticum aestivum
MVLMQADPFLSELTNMYERSTEKGSVWVTMKRSSMKCQARLKKMASKGEPVEYRCLVRATDGKRNISTSLSAKEYLKFQASYALVLKAHMHALKKRERKDRKKTVEAEKIPEKEPKKQKKSSSKKSAGSK

SEQ ID NO: 2359 - protein, 130 aa, Triticum aestivum; identical to SEQ ID NO: 2356

SEQ ID NO: 2360 - protein, 327 aa, Hordeum vulgare
MLLLLAFLAAAGAAAFFLFKFVTADGDFTLLSCGRPRRDKVDGKVVWITGASRGIGEVLSMQFASLGAKLILSARNKEELERVKHNIMSKHPDSKVEVLPMDLSSDEKSLKEVVHSAESLFSSAGIDYMMHNAAFERPKRGALEETEEGLKATFKVNVFGTITLTRLLAPFMLDRGMGHFVVMSSAAGKVPTPGQALYSASKHALNGYFASLRSELCTKGIKVTVVCPGPIETPESSGATSSSQRHSSEKRVSVERCAELTIVAATHGLKEAWISYQPVLAVMYVVQYMPTIGCWLMDKVGAKRVDAAAKKGNAYSWNLLFGGKKSA

SEQ ID NO: 2361 - protein, 327 aa, Brachypodium distachyon
MLLLLLSALLAGAGAGLLFKFATADGDFTLLSRRSPRREKVDGKVVWITGASRGIGEVLSMQFASLGAKLILSARNKEELERVKHNIVCKHPESRVEVLPMDLSSDEESLKEVVHAAESLFSSAGIDYMIHNAAFERPKRGALEETEDGLKATFNVNVFGTITLTRLLAPSMLDRGMGHFVVMSSAAGKVPTPGQALYSASKHALNGYFTSLRSELCTKGIKVTVICPGPIETPQSTGATSSSQRHSSEKRVSVERCAELTIVAATHGLKEAWISYQPVLAVMYLVQYMPTIGYWLMDKIGAKRVDAAAKKGNAYSLNLLFGGKKSA

SEQ ID NO: 2362 - protein, 327 aa, Leymus cinereus x Leymus triticoides
  misc_feature (7)..(7): Xaa can be any naturally occurring amino acid
  misc_feature (10)..(10): Xaa can be any naturally occurring amino acid
  misc_feature (42)..(42): Xaa can be any naturally occurring amino acid
  misc_feature (58)..(58): Xaa can be any naturally occurring amino acid
  misc_feature (263)..(263): Xaa can be any naturally occurring amino acid
  misc_feature (265)..(265): Xaa can be any naturally occurring amino acid
  misc_feature (306)..(306): Xaa can be any naturally occurring amino acid
  misc_feature (314)..(314): Xaa can be any naturally occurring amino acid
  misc_feature (322)..(322): Xaa can be any naturally occurring amino acid
MLLLFAXLAXAAAAAFLLFKFATADGDFTLLSCGRPRRDKVXGKVVWITGASRGIGEXLSMQFASLGAKLILSARNKEELERVKHNIISKHPDSKVEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFASLRSELCTKGIKVTVVCPGPIETPESSGATSSSQRHSSEKRVSVERCAELTIXAXTHGLKEAWISYQPVLAVMYVVQYMPTIGYWLMDKVGAKRVXAAAKKGNXYSWNLLFXGKKSA

SEQ ID NO: 2363 - protein, 327 aa, Pseudoroegneria spicata
MLLLFALLAGGAAAAFLLFKFATADGDFTLLSCGRPRRDKVDGKVVWITGASRGIGEVLSMQFASLGAKLILSARNKEELERVKHNIISKHPDSKVEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFTSLRSELCTKGIKVTVVCPGPIETPESSGATSSSQRHSSEKRVSVERCAELTIVAATHGLKEAWISYQPVLAVMYVVQYMPTIGYWLMDKVGAKRVDAAAKKGNAYSWNLLFGGKKSA

SEQ ID NO: 2364 - protein, 331 aa, Sorghum bicolor
MLLLLLIAVLTAVAAFLLFKFATVVDGDLTLVSRGPPRRDRVDGKVVWITGASRGIGEVLAMQFANLGAKLILSARTKDELERVKKNILSKNPDSRVEVLPMDLSAGEESLKEVVHVAESFFSNAGVDYMIHNAAFERPKRGALEESEEGLKATLNVNVFGTITLTRLLAPYMLDRGTGHFVVMSSAAGKVPAPGQAIYSASKHALNGYFASLRSELCTKGIKVTVVCPGPIETPQSSAAASQVQTHSAEKREKRVSVERCVELTIIAATHGLKEAWISYQPVLTVMYLVQYMPTVGYWLMDKVGAKRLDAAAKKGNTYSWNLIFGSKKSA

SEQ ID NO: 2365 - protein, 328 aa, Panicum virgatum
MLLLILFALLAGAAAFLLFMFATVVDGDLTLVSRGPPRRERVDGKVVWITGASRGIGEVLAMQFANLGAKLILSARNKDELERVKQNILSKNPDSRVEVLPMDLSAGEKSLKQVVHAAESLFSNAGVDYMIHNAAFERPKRGALEESEEGLKATINVNVIGTITLTRLLAPYMLDRGMGHFVVMSSAAGKVPAPGQAIYSASKHALNGYFASLRSELCTKGIKITVVCPGPIETPQSSAAASSVQSHSSERRVSVERCVELTIIAATHGLKEAWISYQPVLTVMYLVQYMPTIGYWLMDKVGAKRLDAAAKKGNTYSWNLIFGGKKSA

SEQ ID NO: 2366 - protein, 340 aa, Triticum aestivum
RRRHGPRTARQPRMLLPFALLAGAAAGAFLLFKFATADGDFTLLSCGRARRDKVEGKVVWITGASRGIGEVLSMQFASLGAKLILSARNKEELERVKRNIMSKHPDSKIEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFASLRSELCTKGIKVTVVCPGPIETPVSSGATSSSQRHSSEKRVSVERCAELTIVAATHGLKEAWISYQPVLAVMYVVQYMPTIGCWIMDKVGAKRVDAAAKKGNAYSWNLLFGGKKSA

SEQ ID NO: 2367 - protein, 371 aa, Triticum aestivum
RGRQTSTTGNSPPSNSHGHTPSRSHQNSERTRRRRGPRTARQPIMLLLFALLAGAGAAAFLLFKFATADGDFTLLSCGRARRDKVDGKVVWITGASRGIGEVLSMQFASLGAKLILSARNKEELERVKRNIISKHPDSKVEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFASLRSELCTKGIKVTVVCPGPIETPVPSGATSSSQRHSSEKRVSVERCAELTIVAATHGLKEAWISYQPVLAVMYVVQYMPTIGWWLMDKVGAKRVDAAAKKGNAYSWNLLFGGKKSA

SEQ ID NO: 2368 - protein, 348 aa, Triticum aestivum
SHQNSERTRRHHGPRTARQPRMLLLFALLAGAAAAAFLVFKFATADGDFTLLSCGRPRRDKVDGKVVWITGASRGIGEVLSMQFASLGAKLILSARNKEELERVKRNIISKHPDSKVEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFASLRSELCTKGIKVTVVCPGPIETPVSSGATSSSQRHSSEKRVSVERCAELTIIAATHGLKEAWISYQPVLAVMYVVQYMPTIGCWLMDKVGAKRVDAAAKKGNAYSWNLLFGGKKSA

SEQ ID NO: 2369 - protein, 447 aa, Hordeum vulgare
SPSSSASPRRGGRRAPSSVRCDASPPAASASASLDPDFDKKAFRHNLTRSDNYNRKGFGHKKETLELMSQEYTSDVIKTLKDNGNEYTWGPVTVKLAEAYGFCWGVERAVQIAYEARKQFPEERIWITNEIIHNPTVNKKLEDMGVKDIPVNAGIKDFDVIEQGDVVVLPAFGAAVDEMYTLNQKNVQIVDTTCPWVSKVWNMVEKHKKGDYTSIIHGKYAHEETVATASFAGKYIIVKNMVEATYVCDYILGGQLDGSSATREEFLEKFKKAVSPGFDPDVDLEKVGIANQTTMLKGETEEIGKLVEKTMMRKFGVENANEHFVAFNTICDATQERQDAMYHLVKEKVDLILVIGGWNSSNTSHLQEIGELSGIPSYWIDSEQRIGPGNRIAYKLNHGELIEAENWLPEGPITIGVTSGASTPDKVVEDTLHKVFEIKRQEVLQVA

SEQ ID NO: 2370 - protein, 465 aa, Brachypodium distachyon
MATITTQLRSALLSAAAASSTSSSSPRRSGRRAPSSVRCDASPPAASASASLDPDFDKKAFRHNLTRSDNYNRKGFGHKKETLELMSQEFTSDVIKTLKDNGNEYTWGPVTVKLAEAYGFCWGVERAVQIAYEARKQFPEERIWLTNEIIHNPTVNKRLEDMGVKDIPINAGIKDFDVIEQGDVVVLPAFGAAVEEMYTLNEKNVQIVDTTCPWVSKVWNMVEKHKKGDYTSIIHGKYAHEETVATASFAGKYIIVKNMVEAMYVCDYILGGQLDGSSSTREEFLEKFKKAVSPGFDPDVDLEKVGIANQTTMLKGETEEIGKLVEKTMMRKFGVENANEHFVAFNTICDATQERQDAMYQLVKDKVDLILVIGGWNSSNTSHLQEIGELSGIPSYWIDSEQRIGPGNRISYKLNHGELIETENWLPEGPITIGVTSGASTPDKVVEDALHKVFEIKRQEILQVA

SEQ ID NO: 2371 - protein, 466 aa, Ricinus communis
MAISLQLCRLSLRTDLFSRDNNSSPLLRRKPFSIRCSAAAASDDESSSASVAMDSDFDAKVFRHNLTRSKNYNRRGFGHKEETLQLMSQEYTSDIIKTLKENGNEYTWGNVTVKLAEAYGFCWGVERAVQIAYEARKQFPDEKIWITNEIIHNPTVNKRLEEMNVENIPLEEGRKQFEVVNNGDVVILPAFGAAVDEMLTLSNKNVQIVDTTCPWVSKVWNTVEKHKKGDYTSIIHGKYSHEETIATASFAGTYIIVKNMKEAMYVCDYILGGQLNGSSSTKEEFLKKFKNAVSKGFDPDVDLVKVGIANQTTMLKGETEDIGKLVEKTMMQRYGVENVNDHFISFNTICDATQERQDAMFNLVEEKLDLILVIGGWNSSNTSHLQEIAELRGIPSYWIDSEQRIGPGNRIAYKLNHGELVEKENFLPEGPITIGVTSGASTPDKVVEDALVKVFDIKREEALQLA

SEQ ID NO: 2372 - protein, 462 aa, Zea mays
MATITTPLRSALFSPAASSAGRHRGGRRRAPSSVRCDASPPSHAAAASLDPDFDKKAFRHNLTRSDNYNRKGFGHKKETLELMSQEYTSNVIKTLKENGNQYTWGPVTVKLAEAYGFCWGVERAVQIAYEARKQFPEERIWLTNEIIHNPTVNKRLDEMGVEIIPVDAGIKDFNVVEQGDVVVLPAFGAAVEEMYTLNEKKVQIVDTTCPWVSKVWNMVEKHKKSEYTSIIHGKYSHEETVATASFAGKYIIVKNMAEATYVCDYILGGQLDGSSSTKEEFLEKFKKAVSPGFDPDVHLDMVGIANQTTMLKGETEEIGKLIEKTMMQKYGVENVNDHFMAFNTICDATQERQDAMYQLVKEKVDLILVVGGWNSSNTSHLQEIGELSGIPSYWIDSEQRIGPGNRISYKLNHGELVEKNNWLPEGPITIGVTSGASTPDKVVEDALQKVFEIKRQEILQVA

SEQ ID NO: 2373 - protein, 463 aa, Pseudoroegneria spicata
MATITTQLRSALLSPAASSSCSSPRRGGRRAPSSVRCDASPPAASASASLDPDFDKKAFRHNLTRSDNYNRKGFGHKKETLELMSQEYTSDVIKTLKDNGNEYTWGPVTVKLAEAYGFCWGVERAVQIAYEARKQFPEERIWITNEIIHNPTVNKKLEDMGVKDIPVNAGIKDFDVIEQGDVVVLPAFGAAVDEMYTLNQKNVQIVDTTCPWVSKVWNMVEKHKKGDYTSIIHGKYAHEETVATASFAGKYIIVKNMVEATYVCDYILGGQLDGSSSTREEFLEKFKKAVSPGFDPDVDLEKVGIANQTTMLKGETEEIGKLVEKTMMRKYGVENANEHFVAFNTICDATQERQDAMYHLVKEKVDLILVIGGWNSSNTSHLQEIGELSGIPSYWIDSEQRIGPGNRISYKLNHGELIEAENWLPEGPITIGVTSGASTPDKVVEDTLHKVFEIKRQEVLQVA

SEQ ID NO: 2374 - protein, 464 aa, Sorghum bicolor
MATITTPLRAALLSPAAASSAGRRRGGGGRRRAPSSVRCDASPPSSSAASFDPDFDKKAFRHNLTRSDNYNRKGFGYKKETLELMSQEYTSDVIKTLKENGNQYTWGPVTVKLAEAYGFCWGVERAVQIAYEARKQFPEERIWLTNEIIHNPTVNKRLDEMGVDIIPVDAGIKDFNVVEQGDVVVLPAFGAAVEEMYTLNEKKVQIVDTTCPWVSKVWNMVEKHKKSEYTSIIHGKYSHEETVATASFAGKYIIVKNMAEATYVCDYILGGQLDGSSSTKEEFLEKFKKAVSPGFDPDVDLDMLGIANQTTMLKGETEEIGKLVEKTMMQKYGVENVNDHFMAFNTICDATQERQDAMYQLVKEKVDLILVIGGWNSSNTSHLQEIGELSGIPSYWIDSEQRIGPGNMISYKLNHGELVEKENWLPEGPITIGVTSGASTPDKVVEDALQKVFEIKRQEILQVA

SEQ ID NO: 2375 - protein, 415 aa, Saccharum officinarum
  misc_feature (213)..(213): Xaa can be any naturally occurring amino acid
  misc_feature (290)..(290): Xaa can be any naturally occurring amino acid
SLDPDFDKKAFRHNLTRSDNYNRKGFGYKKETLELMSQEYTSDVIKTLKVNGNQYTWGPVTVKLAEAYGFCWGVERAVQIAYEARKQFPEERIWLTNEIIHNPTVNKRLDEMGVEIIPVDAGIKDFNVVEQGDVVVLPAFGAAVEEMYTLNEKKVQIVDTTCPWVSKVWNMVEKHKKSEYTSIIHGKYSHEETVATASFAGKYIIVKNMAEAXYVCDYILGGQLDGSSSTKEEFLEKFKKAVSPGFDPDVDLDMVGIANQTTMLKGETEEIGKLVEKTMMQKYGVENVNXHFMAFNTICDATQERQDAMYQLVKEKVDLILVIGGWNSSNTSHLQEIGELSGIPSYWIDSEQRIGPGNMISYKLNHGELVEKVNWLPEGPITIGVTSGASTPDKVVEDALQKVFEIKRQEILQVA

SEQ ID NO: 2376 - protein, 415 aa, Panicum virgatum
SLDPDFDKKAFRHNLTRSDNYNRKGFGHKKETLELMSQEYTSDVIKTLKENGNQHTWGPVTVKLAEAYGFCWGVERAVQIAYEARKQFPEERIWLTNEIIHNPTVNKRLDEMGVEIIPVDAGIKDFNVVEKGDVVVLPAFGAAVEEMYTLNDKKVQIVDTTCPWVSKVWNTVEKHKKSEYTSIIHGKYSHEETVATASFAGKYIIVKNIAEATYVCDYILGGKLDGSSSTKEAFLEKFKNAVSPGFDPDVDLDKVGIANQTTMLKGETEEIGKLVERTMMQRYGVENVNDHFMAFLTICDATQERQDAMYQLVKEKVDLILVVGGWNSSNTSHLQEIGELSGIPSYWIDSEQRIGPGNRISYKLNHGELVEKENWLPEGPITIGVTSGASTPDKVVEDALQKIFEIKRQEILQAA

SEQ ID NO: 2377 - protein, 464 aa, Triticum aestivum
MATITTQLRSALLSPAASSSSSSSPRRGGRRAPSSVRCDASPPAASASASLDPDFDKKAFRHNLTRSDNYNRKGFGHKKETLELMSQEYTSDVIKTLKDNGNEYTWGPVTVKLAEAYGFCWGVERAVQIAYEARKQFPEERIWITNEIIHNPTVNKKLEDMGVKDIPVNAGIKDFDVIEQGDVVVLPAFGAAVDEMYTLNEKNVQIVDTTCPWVSKVWNMVEKHKKGDYTSIIHGKYAHEETVATASFAGKYIIVKNMVEATYVCDYILGGQLDGSSSTREEFLEKFKKAVSPGFDPDVDLEKVGIANQTTMLKGETEQIGKLVEKTMMRKYGVENANEHFVAFNTICDATQERQDAMYHLVKEKVDLILVIGGWNSSNTSHLQEIGELSGIPSYWIDSEQRIGPGNRISYKLNHGELIEAENWLPEGPITIGVTSGASTPDKVVEDTLHKVFDIKRQEVLQVA

SEQ ID NO: 2378 - protein, 110 aa, Musa acuminata
MDSNRRQSGIQQLLAAEQEAQRIVNEARNAKMARLKQAKEEADKEIAAYRAQMEAEFQKKVAQSSGDSGANVKRLELETEEKIQHLKSQAANISEDVGQMLLKHVTTVKN

SEQ ID NO: 2379 - protein, 110 aa, Musa acuminata
MDSSRRQSGIQQLLAAEQEAQRIVNEARNAKMARLKQAKEEADKEIAAYRAQMEAEFQRKVAQSSGDSGANVKRLELETEEKIQHLKSQAANISQDVVQMLLKHVTTVKN

SEQ ID NO: 2380 - protein, 110 aa, Hordeum vulgare
MDASRRPSGIQQLLAAEQDAQQIVNAARAAKTARLRKAKEEAEREIAEYRAQMEADFQRKLTETSGDSGANVKRLEQETNVKIEQLKQQAANISPEVIQMLLRHVTTVKN

SEQ ID NO: 2381 - protein, 110 aa, Brachypodium distachyon
MDANRRQSGIQQLLAAEQEAQQIVNAARAAKLARLRQAKEEAEREIAEYRAQMEADFQRKLAESSGDSGANVKRLEQETNEKIAQLKQQAATISPEVIQMLLRHVTTVKN

SEQ ID NO: 2382 - protein, 110 aa, Brachypodium distachyon
MDANRRQSGIQQLLAAEQEAQQIVNAARAAKLARLRQAKEEAEREIAEYRAQMEAEFQRKVAESSGDSGANVKRLEQETNEKIAQLKQQAATISPEVIQMLLRHVTTVKN

SEQ ID NO: 2383 - protein, 110 aa, Cenchrus ciliaris
MDASRRQSGIQQLLAAEQEAQQIVNAARAAKSARLRQAKEEAQREIDEYRKQMENEFQRKVAESSGDSGANVKRLEQETAAKIEQLNQQAANISPEVIQMLLRHVTTVKN

SEQ ID NO: 2384 - protein, 110 aa, Festuca arundinacea
MDASRRPSGIQQLLAAEQEAQQIISTARAAKSARLRQAKEEAEREIAEYRAQMEADFQKKLAETSGDSGANVKRLEQETNEKIEQLKQQAASISPEVIQMLLRHVTTVKN

SEQ ID NO: 2385 - protein, 110 aa, Actinidia deliciosa
MEASRGQNGIQMLLAAEQEAQRIVNAARAAKMARLKQAKEEAEKEIAEFRAQMEAAFQRKVAESSGDSGANVKRLEQETEAKIHHLKKEAARISPDVVQMLLRHVTTVKN

SEQ ID NO: 2386 - protein, 110 aa, Leymus cinereus x Leymus triticoides
MDSSRRPSGIQQLLAAEQDAQQIVNAARAAKTARLRQAKEEAEREIAEYRAQMEADFQRKLTETSGDSGANVKRLEQETNVKIEQLKQQAANISPEVIQMLLRHVTTVKN

SEQ ID NO: 2387 - protein, 110 aa, Lolium multiflorum; identical to SEQ ID NO: 2384

SEQ ID NO: 2388 - protein, 110 aa, Eragrostis curvula
  misc_feature (3)..(3): Xaa can be any naturally occurring amino acid
  misc_feature (8)..(8): Xaa can be any naturally occurring amino acid
  misc_feature (68)..(68): Xaa can be any naturally occurring amino acid
  misc_feature (87)..(87): Xaa can be any naturally occurring amino acid
MDXSRRQXGIQQLLAAEQEAQQIVNAARAAKSARLRQAKEEAEREIAEYRAQMEAEFQRKVAESSGDXGANVKRLEEETAAKIEQLXQQAASISPEVIQMLLRHVTTVKN

SEQ ID NO: 2389 - protein, 110 aa, Zea mays
MDANRRQGGIQQLLAAEQEAQQIVNAARAAKSARLRQAKEEAEREIAEYRAQMEAEFQRKVAESSGDSGANVKRLEEETTAKIEQLNQQAASISPDVIQMLLRHVTTVKN

SEQ ID NO: 2390 - protein, 110 aa, Pennisetum glaucum
MDANRRQSGIQQLLAAEQEAQQIVNAARAAKSARLKQAKEEAEREIAEYRSQMEAEFQRKVAESSGDSGANVKRLEQETAAKIEQLNQQAASISPEVIQMLLRHVTTVKN

SEQ ID NO: 2391 - protein, 110 aa, Pennisetum glaucum
MDASRRQSGIQQLLAAEQEAQQIVNAARAAKSARLRQAKEEAQREIDEYRTQMENEFQRKVAESSGDSGANVKRLEQETAAKIEQLNQQAANISPEVIQMLLRHVTTVKN

SEQ ID NO: 2392 - protein, 95 aa, Ananas comosus
  misc_feature (95)..(95): Xaa can be any naturally occurring amino acid
MDPNRRQGGIQQLLAAEQEAQQIVNAARNAKLARLKQAKEEADKEIAEYRAHMEAEFQKKVAESSGDSGANVKRLEQETEAKIRAPQVTSRKHLX

SEQ ID NO: 2393 - protein, 174 aa, Oryza sativa
MGKYGVELDAVALNSLLSVMCRGDDRAQAAQDLFEHTCRSYHPHRSAPGSCKAATCNPNTPSRIVVRAAEGRWMLTDAKVEFSNYWLQSKKLNRLLMLLGAAKEEAEREIAEYRAQMEAEFQRKVAESSGDSGANVKRLEQETDTKIAQLKEQAANVSPEVIQMLLRHVTTVKN

SEQ ID NO: 2394 - protein, 110 aa, Sorghum bicolor
MDANRRASGIQQLLAAEQEAQQIVNAARAAKSARLKQAKEEAEREIAEYRAQMEAEFQRKVAESSGDSGANVKRLEEETAAKIEQLSQQAASISPDVIQMLLRHVTTVKN

SEQ ID NO: 2395 - protein, 110 aa, Sorghum bicolor
MDANRRQSGIQQLLAAEQEAQQIVNAARAAKSARLRQAKEEAEREIAEYRAQMEAEFQRKVAESSGDSGANVKRLEEETTAKIEQLSQQAASISPEVIQMLLRHVTTVKN

SEQ ID NO: 2396 - protein, 110 aa, Saccharum officinarum
MDANRRQSGIQQLLAAEQEAQQIVNAARAAKSARLKQAKEEAEREIAEYRAQMEAEFQRKVAESSGDSGANVKRLEEETAAKIELLNQQAASISPDVIQMLLRHVTTVKN

SEQ ID NO: 2397 - protein, 110 aa, Saccharum officinarum
MDANRRQSGIQQLLAAEQEAQQIVNAARAAKSARLKQAKEEAEREIAEYRAQMEAEFQRKVAESSGDSGANVKRLEEETTAKIELLNQQAASISPDVIQMLLRHVTTVKN

SEQ ID NO: 2398 - protein, 106 aa, Saccharum officinarum
  misc_feature (14)..(14): Xaa can be any naturally occurring amino acid
  misc_feature (46)..(46): Xaa can be any naturally occurring amino acid
  misc_feature (59)..(59): Xaa can be any naturally occurring amino acid
  misc_feature (68)..(68): Xaa can be any naturally occurring amino acid
  misc_feature (83)..(83): Xaa can be any naturally occurring amino acid
MDANRRQSGIQQLXAAEQEAQQIVNAARAAKSARLRQAKEEAEREXAEYRAQVEAEFQXKVAESSGDXGANVKRLEEETATKXEQLNQQAASISPMLLRHVTTVKN

SEQ ID NO: 2399 - protein, 110 aa, Panicum virgatum
MDASRRQSGIQQLLAAEQEAQQIVNAARAAKSARLKQAKEEAEREIAEYRKQMEAEFQRKVAESSGDSGANVKRLELETAAKIEQLNQQAASISPEVIQMLLRHVTTVKN

SEQ ID NO: 2400 - protein, 110 aa, Panicum virgatum
MDASRRQSGIQQLLAAEQEAQQIVNAARAAKSARLRQAKEEAEREIAEYRKQMEDEFQRKVAESSGDSGANVKRLEQETAAKIEQLNQQAASISPEVIQMLLRHVTTVKN

SEQ ID NO: 2401 - protein, 110 aa, Panicum virgatum
MDANRRQSGIQQLLAAEQEAQQIVNAARAANSARLRQAKEEAEREIAEYRSQMEAEFQRKVAESSGDSGANVKRLEQETAAKIKQLNQQAASISPEVIQMLLRHVTTVKN

SEQ ID NO: 2402 - protein, 110 aa, Nicotiana tabacum; identical to SEQ ID NO: 2380

SEQ ID NO: 2403 - protein, 110 aa, Triticum aestivum
MDSSRRPSGIQQLLAAEQEAQQIVNAARAAKTARLRQAKEEAEREIAEYRAQMEADFQRKLTETSGDSGANVKRLEQETTVKIEQLKQQAANISPEVIQMLLRHVTTVKN

SEQ ID NO: 2404 - protein, 110 aa, Triticum aestivum
MDSSRRPSGIQQLLAAEQEAQQIVNAARAAKTARLRQAKEEAEREIAEYRAQMEADFQRKLTETSGDSGANVKRLEQETNVKIEQLKQQAANISPEVIQMLLRHVTTVKN

SEQ ID NO: 2405 - protein, 62 aa, Triticum aestivum
MDSSRRPSGIQQLLAAEQEAQQIVNAARAAKTARLRQAKEEAEREIAEYRAQMEADFQEEAH

SEQ ID NO: 2406 - protein, 110 aa, Triticum aestivum
MDANRRQSGIQQLLAAEQEAQQIVNAARAAKSARLKQAKEEAEREIAEYRAQMEAEFQRKVAESSGDSGANVKRLEEETAAKIEQLSQQAASISPDVIQMLLRHVTTVKN

SEQ ID NO: 2407 - protein, 136 aa, Triticum aestivum
  misc_feature (99)..(99): Xaa can be any naturally occurring amino acid
MDANRRQSGIQQLLAAEQEAQQIVNAARAAKSARLRQAKEEAEREIAEYRAQMEAEFQRKVAESSGDSGANVKRLEEETAAKIEQLTQQATTSPRMSFXCFCGIHHRQELRSAVPELCSQTCTSIYLFVKSESGEE

SEQ ID NO: 2408 - protein, 200 aa, Festuca arundinacea
  misc_feature (11)..(11): Xaa can be any naturally occurring amino acid
  misc_feature (94)..(94): Xaa can be any naturally occurring amino acid
ARGLLACCLLXATEMAFTLVGAFKGLSLSSSSSFLRGDRAALGGNSVGMGVGVATLPARGLTIQMAHKKGAGSTKNGRDSKGQRLGVKIYGDQXAKPGAIIIRQRGTKVYPGNNVGMGKDHTLFALIDGLVKFEKYGPDRKKVSVYPYEKQPENPNSYRARKRENFRLQRERKKARAERTYEPQLVLAAADESVEAKADC

SEQ ID NO: 2409 - protein, 184 aa, Leymus cinereus x Leymus triticoides
MAFTLVGAFKGLSLASSSSFLRGDRAALPGGAGGVGVVTLPARGLTIQMAHKKGAGSTKNGRDSKGQRLGVKIYGDQLAKPGAIIIRQRGTKVYPGNNVGMGKDHTLFSLIDGLVKFEKYGPDRKKVSVYPYEKQPENPNSYRARKRENFRLQRERLKARAEGSYEPELVLAAADASVEVNADC

SEQ ID NO: 2410 - protein, 186 aa, Zea mays
MAFALAGAFKGLSLVPTTTSSFPRGDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKKVSVYPYEKEPENPNSYRARKREYFRMRRERKKARAEGAAEPQLVLAAVDENSEVSADC

SEQ ID NO: 2411 - protein, 185 aa, Pseudoroegneria spicata
MAFTLVGAFKGLSLASSSSFLRGDRTALPGGTTGGVGVATLPARGLTIQMAHKKGAGSTKNGRDSKGQRLGVKIYGDQLAKPGAIIIRQRGTKVYPGNNVGMGKDHTLFSLIDGLVKFEKYGPDRKKVSVYPYEKQPENPNSYRARKRENFRLQRERLKARAEGSYEPELVLAAADASVEVNADC

SEQ ID NO: 2412 - protein, 189 aa, Sorghum bicolor
MASMAFALAGAFKGLSLAPTTTSFLRGDRVSLSVGGGSGAVGVSVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKEPENPNSYRARKREYFRMRRERKKARAEGATEPQLVLAAVDKNSEASADC

SEQ ID NO: 2413 - protein, 186 aa, Saccharum officinarum
MASMAFALAGAFKGLSLAPTTTTFLRGDRASLSVGGAVGVPVPARRLTIQMAHKKGAGSTKNGRDSKGQRLGVKIYDDQVAKPGAIIIRQRGTRVYPGNNVGMGKDHTLFSLIDGLVKFEKYGPDKKKVSVYPYEKEPENPNSYRARKREYFRMRRERKKARAEGATEPQLVIAAVDENSEVSADC

SEQ ID NO: 2414 - protein, 191 aa, Panicum virgatum
MASMAFSLAGAFKGLSLASPSSSMRPAFLRGDRAALSVGGAAVGVPVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGAIEPQLVLAAVDENSEVSTDC

SEQ ID NO: 2415 - protein, 191 aa, Panicum virgatum
MASMAFSLAGAFKGLSLATPSSSMRPSFLRGDRAALSVGGAAVGVPVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGAVEPQLVLAAVDENSEVSADC

SEQ ID NO: 2416 - protein, 206 aa, Triticum aestivum
RAEFGTSRCWLAAAAFLRATEMAFTLVGAFKGLSLASSSSFLRGDRAALPGGATGGVGVATLPARGLTIQMAHKKGAGSTKNGRDSKGQRLGVKIYGDQLAKPGAIIIRQRGTKVYPGNNVGMGKDHTLFSLIDGLVKFEKYGPDRKKVSVYPYEKQPENPNSYRARKRENFRLQRERLKARAEGTYEPELVLAAADASVEVNADC

SEQ ID NO: 2417 - protein, 295 aa, Triticum aestivum
MGAGMVELGPGVVEVGAAEAAQTVPPAKRRRVLAVKTAAAAAAGRRPRRDRRPTAIQRLFQACRAVFKGPGTVPKPAEVALLRAMLDKMRPEDVGLSSNMPFFRNREAATEGTPTITHTTIYKSEKFSMVLFFLPTNAVIPLHNHPGMTVFNKLLIGSMHAKSYDWADPDDPANESGASSPDGKLRLAQLVVDDVFTAPCDTSVLFPTAGGNMHRFRAVAPSAFLDILGPPYSIEEDRDCTYYTDIPYSEHRMTSNEPIGDEQEGRRLAWLKEVEMPKDLKMCSVRYGGPPISGR

SEQ ID NO: 2418 - protein, 250 aa, Brachypodium distachyon
MANEHLVLVHGEGHGGWCWFKLRWLLEGSGYRVTCIDLAGGGVDPTDPNTVRSFEQYDKPLLDLISALPEGEKVILIGHGIGGLSVIHAMHEFVDRIKEAIFVAAAMLPFGLQTDEDKKDGLPSLPENEVQLTFGAGADDPPTTVALRLEFQRDRLSQQSPEEDSILASMLMRPWPVSAIGTASFEGDDERLNRIKRVFIKTQRDHMLEPQQQDSMIKKWPPSEVLIIDTDHSPFFSAPEQLFNLIVKSL

SEQ ID NO: 2419 - protein, 253 aa, Zea mays
MGMAAKEHFVLVHGEGHGAWCWFKLRWLLEGAGYHVTCIDLAGGGVDPTDPNTIRSFQQYDKPLIDLISTLPEGEKVILIGHGAGGLSVIHAMHEFVDRISQAFFVAATMLPFGFQADEDKKDGLPTLPENEIELTLGAGADDPPTTISLRPEFQRDRLSQQSPEEESVLASMLMRPWPATAISTASFEGDDERLNRIKRIFIKMQRDHMLDPQQQDSMIKKWPPSEVLAIDTDHSPFFSAPEQLFNLIVKSL

SEQ ID NO: 2420 - protein, 253 aa, Zea mays
MGMAKEQHFVLVHGEGHGAWCWFKLRWLLEGAGHRVTCVDLAGGGVDPTDPNTIRSFKQYDKPLIDLISNLPDGEKVILIGHGAGGLSVIHAMHEFVDRIGQAFFVAATMLPFGFQADEDKNDGLPTLPENEIELTLGAGADDPPTTIALRPEFQRDRLSQQSPEEESVLASMLMRPWPATAISTASFEGDDERLNRIKRTFIKMERDHMLDPQQQDSMIKKWPPSEVLVIDTDHSPFFSAPEQLFNLIVKSL

SEQ ID NO: 2421 - protein, 250 aa, Oryza sativa
MAREHFVLIHGEGHGSWCWFKLRWLLESSGYQVTCIDLAGAGVDPTDPNTVQSFEQYDKPLLDLISAIPEDEKVILVGHGSGGLSLIHAMHQFVDRIRQAIFVAATMLPFGLQTDEDKKDGLPTLPENEINLIFGTGADDPPTTAALRPEFQRERLSQQSPEEESVLASMLMRPWPVTAISTASFEGDDERLNRIKRVFIKTERDHMLDPQQQDSMIKKWPPSEVLEIDTDHSPFFSAPEQLFNLIVKSL

SEQ ID NO: 2422 - protein, 245 aa, Oryza sativa
MAREHFVLVHGEGHGSWCWFKLRWLLESSGYQVTCIDLAGAGVDPTDPNTVRSFEQYDKPLLDLISAIPEDEKVILVGHGSGGLSLIHAMHQFVDRIRQAIFVAATMLPFGLQTDEDKKDGLPTLPENEINLIFGTGADDPPTTAALRPEFQRERLSQQSPEEESVLASMLMRPWPVTAISTASFEGDDERLNRIKRVFIKTERDHMLNPQQQDSMIKKWPPRKSCQRRQPPPITPSFQELKKIL

SEQ ID NO: 2423 - protein, 251 aa, Sorghum bicolor
MAAKEHFVLVHGEGHGAWCWFKLRWLLEGAGYRVTCIDLAGGGVDPTDPNTIRSFKQYDKPLIDLISTLPEGEKVILVGHGAGGLSVIHAMHEFVDRISQSFFVAATMLPFGFQADEDKKDGLPTLPENEIELTLGAGADDPPTTIALRLEFQRDRLSQQSPEEESVLASMLMRPWPATAISTASFEGDDERLNRIKRIFIKTERDHMLDPQQQDSMIKKWPPSEVLVIDTDHSPFFSAPEQLFNLIVKSL

SEQ ID NO: 2424 - protein, 131 aa, Panicum virgatum
MGMAKEHFVLVHGEGHGAWCWFKLRWLLEGSGYRVTCIDLAGGGVDPTDPNTVRSFKQYDKPLMDLISTLPEGEKVILVGHGAGGLSVIHAMHEFVDRISQAFFVAATMLPFGLQTDEDKKDQMILQQPLP

SEQ ID NO: 2425 - protein, 708 aa, Oryza sativa
MATVTPGVLLKLLQAMHTDDRVAGDHRSPVLQVTAVVPALTASTADSLWPSNGFLLQLSDGLHSTYVQPSSADADALVSARPQLVGHLVHLDRLRFARPVPRAVGIRPVPSSRSVSFVGNPEPLVARPAACSRGYVIQPGSHSDAAPPLMPSSSGNAAQSDATNAINRTVLAHKNVPEAAPPPAVSAAKRRFSSPAPSKQRDPSPSVKGGASRPSSPSVKGASRASSPAVRGTPRATSPAPSKCVVPSLVAAKEENRRTAREPAIIVPSRYRQPSPVGGRRGAGSPAPGGRRASLSPSSRRLSGEGSSKKKVGVLVAGISKMTDLTNGSAVKPGRKSWDNTSIAAAAGSVMKSKVKVDKSTILRTQEAMARRLSDVTTELSSNDDDSSVDEKPKPRKKIESPAVKTKAMAPKIMLHDPKWTDGSIPLDGVSDVLSKMGKEATERRDAAAIAAADALQEALITESVIRNLSKFSELTSASKTSNPLPTVDIFLAVYEDTLKWKKIAESISTNRTETASWENSVTHWVEAALATDLEVLKLMNKAPESLSRKRGADKPKAPLVVEAPRTTISKRQSHGTSAKVQSKVLPTSSASCAWNKTQGVNETAELATTLCCEMHTWFLKFVDEAMDLGFHLFEDQNVASRGKQSSHITMVLSQFKKISDWLDGVGKIAEEATTKDKVEQLKCKIYGFVINHMGSAFDSSVSISSRN

SEQ ID NO: 2426 - protein, 148 aa, Brachypodium distachyon
MAKCSKIRNIVWLRQTLRRWRSRAAARSASSSSPVPAGHVAVCVGGASRRFVVRAAHLNHPVFRELLRQAEEELGGFPSFHGPVALPTCDEALFEHVLRHLSSPSPAARFLTLDDLQSAAGAALSPCCCAAADALPLLRGISSDKFVW

SEQ ID NO: 2427 - protein, 142 aa, Zea mays
MAKCSSKIRYIVWLRQTLRRWRSRAAARAAVPAGHVAVCVGGAARRFVVRAAHLNHPVFRELLRQAEEEYGFPSGACAGPIALPCDEGLFEHVLRHLSSPSKSARFVTLEDLESGALSCCCVAAAGDSLPLLRGISADKAVW

SEQ ID NO: 2428 - protein, 150 aa, Sorghum bicolor
MAKCSSKIRYIVWLRQTLRRWRSRAAARAAVEAAAVPVPAGHVAVCVGGASRRFVVRAAHLNHPVFRELLRQAEEEYGFPSGACAGPIALPCDEGLFEHVLRHLSSPSKSSRFVTLEDLKSGAGLSCCCVVAAGDSLPLLHGISADKAVW

SEQ ID NO: 2429 - protein, 152 aa, Saccharum officinarum
MAKCSSKIRYIVWLRQTLRRWRSRAAARAAAVEAAAVVPVPAGHVAVCVGGASRRFVVRAAHLNHPVFRELLRQAEEEYGFPSGACAGPIALPCDEGLFEHVLRHLSSPSKSSRFVTLEDLKSGAGLSCCCVAAAGDSLPLLHGIAADKAVW

SEQ ID NO: 2430 - protein, 148 aa, Panicum virgatum
MAKCSSKIRYIVWLRQTLRRWRSRAAARAAVAAEAVVPAGHVAVSVGGASRRFVVRAAHLNHPVFRELLRQAEEEYGFPSGACAGPIALPCDEGLFEHVLRHLSSPSKASRFVTLEDIKSGTLSCCCVAAAGDSLPLLHGIAADKAVW

SEQ ID NO: 2431 - protein, 151 aa, Triticum aestivum
MAKCSKIRNIVWLRQTLRRWRSRAAARTAAGGGAGAVSVPAGHVAVCVGGSSRRFVVRAAHLNHPVFRELLRQAEEEYGFPSGASGACGPIALPCDEGLFEHVLRHLSSSSSAARFFTLEDIKSGAYSCCCAAAGDALPLLRGISSDKFVW

SEQ ID NO: 2432 - protein, 551 aa, Oryza sativa
MTTTTTTTNHSAKSILLLALLLVPHLAAASSGDALISQRRRLLDYHGGGGGHGGGDVYVDPSYTFPNARLRDAYVAMQAWKRAVLSDPHNVTGTWIGPDVCAYEGVFCAAARDDPHLVVVASVDLNHADMAGHLPDELGLLADLAVLHANSNRFCGAVPSTLERLHLLHELDLSNNRLVGAFPDVVLRLPSLRYLDLRFNDFEGPVPAELFDRPLDAIFLNSNRLRFRIPDNVGNSPASVLVLANNDFGGCLPASVANMSGTLDEIILMNTGLKSCIPPELGMLTGLAVLDVSHNSLMGAIPGELARLENIEQLDLGHNRLTGDVPEGICHLPHLQNFTYSYNFITGEPPVCMHVKAFDDRRNCIPGRPDQRPAEQCQFQNTHHVNCDAFRCKKFVLPSPPPPSPPPPSPPPPSPSPPPPSPPPPSPPPPSPSPPPPSPPPPSPPPPSPVYYSSPPPPYYEVSPEDRYLSPPPPPAYHEAPPPPYYEVSPEDRYLSPPPPPAYQETPPPPPQYEVSPEDRYLSPPPPSPVKWKLPVYEYSSPPPPAATWKP

SEQ ID NO: 2433 - protein, 128 aa, Oryza sativa
MAKDPHVSISLTGLAMVVLLIFSSSFLQAAQGSDKKMAMKYDVPVKRLVYRPSAMQAAVIGTEAAAYEPFELCMGCRCCASSNASSCVDTRCCYAIDCNIPGKPFGVCAFSPHTCDCGATNCTSQQQP

SEQ ID NO: 2434 - protein, 219 aa, Brassica rapa
EMAASAAPPCVRISSSTPSLTALRRPRRRRVTSARCSLAAAPGLRAPAELVDSILSKVKGTDRGVLLPAEGHQEVADVALQLGKYCIDEPVKSPLIFGDWEVVYCSVPTSPGGIYRTPLGRLVFKTDDMVQVVEAPDIVRNKVSFSIFGLDGAVSLKGKLNVLDSKWIQVIFEPPELKVGSLGFRYGGESEVKLEITYVDEKIRLGKGSRGSLFVFLRQ

SEQ ID NO: 2435 - protein, 224 aa, Festuca arundinacea
  misc_feature (144)..(144): Xaa can be any naturally occurring amino acid
  misc_feature (177)..(177): Xaa can be any naturally occurring amino acid
  misc_feature (180)..(180): Xaa can be any naturally occurring amino acid
  misc_feature (190)..(190): Xaa can be any naturally occurring amino acid
  misc_feature (200)..(200): Xaa can be any naturally occurring amino acid
HEGQKEMAASAPPSCVRISSSTPPLTALHRPCRRPVPSVRCSLAAAPGVRAPAELVDSILSKVKGTDRGVLLPKEGHEEVADVALQLGKYCIDEPVKSPLIFGEWEVVYCSVPTSPGGIYRTPLGRLVFKTNDMVQVVEAPDIXRNKLSLSVFGLDGAVSLKGKLNVLDSKWIQVIXEPXELKVGSLGFXYGGESEVKLXITYVDEKIRLGKGSRGSLFVFLRQ

SEQ ID NO: 2436 - protein, 219 aa, Leymus cinereus x Leymus triticoides
MAACAAPPCVRISSSTPSLTALHRPRRRRVSSARCSLAAAPGLRAPAELVDSILSKVKGTDRGVLLPEEGHQEVADVAQQLGKYCIDEPVKSPLIFGDWEVVYCSVPTSPGGIYRTPLGRLVFKTDDMVQVVEAPDIVRNKVSFSIFGLDGAVSLKGKLNVLDSKWIQVIFEPPELKVGSLGFRYGGESEVKLEITYVDEKIRLGKGSRGSLFVFLRQD

SEQ ID NO: 2437 - protein, 221 aa, Zea mays
MKMSASVAAASPTLRFSSATHPLHRPLRRRLPSVRCSLAAAAGPGVRAPPELVDSILSKVKGTDRGVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 2438 - protein, 217 aa, Zea mays
ASVAAASPTLRFSSATHPLHRPLRRRLPSVRCSLAAAAGPGVRAPPELVDSILSKVKGTDREVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 2439 - protein, 219 aa, Oryza sativa
MSASAAPTHIRFSSAAPPSAAALRRPRRRCATPVRCSLAAAPGLRAPPELIDSILSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKVGSLGFQYGGESEVKLEITYVDEKIRLGKGSRGSLFVFMRR

SEQ ID NO: 2440 - protein, 222 aa, Sorghum bicolor
MKMSASAAAASPALRFSSATPPLAPLHRPPRRRLPTVRCSLAAAPGVRAPPELVDSILSKVKGTDRGVLLPQEGHQEVADVALQLGKYCIDDPVKSPLIFGEWEVMYCSVPTSPGGLYRTPLGRLIFKTDEMIQVVEAPDIVRNKVSFSIFGLEGAVSLKGKLNVLDSKWIQVIFEAPELKVGSLGFQYGGESEVKLEITYVDEKIRLGKGSRGSLFVFLRR

SEQ ID NO: 2441 - protein, 91 aa, Saccharum officinarum
MIQVVEAPDIVRNKVSFSVFGLEGAVSLKGKLNVLDSKWIQVIFEAPELKVGSLGFQYGGESEVKLEITYVDEKIRLGKGSRGSLFVFLRR

SEQ ID NO: 2442 - protein, 228 aa, Panicum virgatum
RETQRRNMFASAAAVSPVLRLSSATPPLAPLHRPFRRRLPSVRCSLAAAPGVRAPPELVDSILSKVKGTDRGVLLPKDGHQEVADVALQLGKYCIEEPVKSPLIFGEWEVVYCSVPTSPGGLYRTPLGRLIFKTDEMIQVVEAPDVVRNKVSFSVFGLEGAVSLKGKLNVLDSKWIQVIFEAPELKVGSLGFQYGGDSEVKLEITYVDEKIRLGKGSRGSLFVFLRRG

SEQ ID NO: 2443 - protein, 219 aa, Triticum aestivum
MAACAAPLCVRISCSTPSPTALHRPRRRRVTSARCSLAAAPGLRAPAELVDSILSKVKGTDRGVLLPEEGHQEVADVAQQLGKYCIDEPVKSPLIFGDWDVVYCSVPTSPGGIYRTPLGRLVFKTDGMVQVVEAPDIVRNKVSFSIFGLDGAVSLKGKLNVLDSKWIQVVFEPPELKVGPLGFQYGGESEVKLEITYVDEKIRLGKGSRGSLFVFLRQD

SEQ ID NO: 2444 - protein, 224 aa, Triticum aestivum
KLQKKMAACAAPPCVRISCSTPSPTALRRPRRRRVASARCSLAAAPGLRAPPELVDSILSKVKGTDRGVLLPEEGHQEVADVAQQLGKYCIDEPVKSPLIFGDWDVVYCSVPTSPGGIYRTPLGRLVFKTDDMVQVVEAPDIVRNKVSFSIFGLDGAVSLTGKLNVLDSKWIQVIFEPPELKVGSLGFRYGGESEVKLEITYVDEKIRLGKGSRGSLFVFLRQD

SEQ ID NO: 2445 - protein, 142 aa, Brachypodium distachyon
MATLQLNHIARETADVRGLAAFYEEVLGFERVPSPNYSGFQVAWLRLPGSPDVALHIIERDPAVAVSSPAAAGTSPPPPAQLPRRHHLAFSVADYDGFVTGLRTRGTEMFEKTQPDGRTRQVFFFDPDGNGLEVTSSSKADK

SEQ ID NO: 2446 - protein, 142 aa, Zea mays
MATLQLNHIARETSDVARLAAFYEAVLGFERIPSPTYSGFQVAWLRLPSSPDVALHLIERDPAAAPVAVGPGAEGAPPSQLPRRHHLAFSVADYDGFVTGLKARGTDVFEKSQPDGRTRQVFFFDPDGNGLEVTSAGAGNEK

SEQ ID NO: 2447 - protein, 140 aa, Pseudoroegneria spicata
MATLQLNHIARETADVRGLAAFYEEVLGFERVPSPTYSGFQVAWLRLPGSPDVALHIIERDPAVAAATAPGAAGAPPAQLPRRHHLAFSVADFDGFLSVLKTRGTHLFEKTQPDGRTRQVFFFDPDGNGLEVTSSSPGDK

SEQ ID NO: 2448 - protein, 141 aa, Oryza sativa
MATLQLNHVARETDDVRRLAAFYEEVLGFERVASPNYPAFQVAWLRLPGTPGVALHIIERDPAAAPAAVAPGAAGAPPAQLPRRHHLAFSVADYDGFLTGLKARGTDVFEKTQPDGRTRQVFFFDPDGNGLEVTSSGTGDM

SEQ ID NO: 2449 - protein, 142 aa, Sorghum bicolor
MATLQLNHIARETSDVVRLAAFYEAVLGFERIPSPTYSGFQVAWLRLPSSPDVALHLIERDPAAAPAAVGPGAEGAPPSQLPRRHHLAFSVADYDGFVTGLKARGTEVFEKTQPDGRTRQVFFFDPDGNGLEVTSAGAGSAK

SEQ ID NO: 2450 - protein, 142 aa, Saccharum officinarum
  misc_feature (35)..(35): Xaa can be any naturally occurring amino acid
  misc_feature (43)..(43): Xaa can be any naturally occurring amino acid
  misc_feature (78)..(78): Xaa can be any naturally occurring amino acid
  misc_feature (142)..(142): Xaa can be any naturally occurring amino acid
MATLQLNHIARETSDVVRLAAFYEAVLGFERVPSXTYSGFQVXWLRLPSSPDVALHLIERDPAAAPVTVGPGAEGAPXSQLPRRHHLAFSVAEYDGFVTGLKARGTEVFEKTQPDGRTRQVFFFDPDGNGLEVTSAGAGNDX

SEQ ID NO: 2451 - protein, 142 aa, Panicum virgatum
MATLQLNHIARETSDVARLAAFYEAVLGFERVPSPAYSGFQVAWLRLPGSPDVALHLIERDPTAAPVAVGPGAEGAPPSQLPRRHHLAFSVADYDGFVTGLKARGTELFEKTQPDGRTRQVFFFDPDGNGLEVTSSAAGSDK

SEQ ID NO: 2452 - protein, 142 aa, Panicum virgatum
MATLQLNHIARETSDVARLAAFYEAVLGFERVPSPTYSGFQVAWLRLPGSPDVALHLIERDPAAAPVAVGPGAEGAPPAQLPRRHHLAFSVADYDGFVTGLKARGTELFEKTQPDGRTRQVFFFDPDGNGLEVTSSAAGSDE

SEQ ID NO: 2453 - protein, 142 aa, Triticum aestivum
MATLQLNHIARETGDVRGLAAFYEEVLGFERVPAPAYSGFQVAWLRLPGSPDVALHIIERDPAVAVAVAPGAAQGVGTPAQLPRRHHLAFSVADFDGFLTGLRTRGTQLFEKSQPDGRTRQVFFFDPDGNGLEVTSSSPGDK

SEQ ID NO: 2454 - protein, 139 aa, Triticum aestivum
MATLQLNHIARETGDVRGLAAFYEEVLGFERVPAPAYSGFQVAWLRLPGSPDVALHIIERDPAAAAAAAAPGDATPAQLPRRHHLAFSVADFDGFLTGLRTRGTQLFEKSQPDGRTRQVFFFDPDGNGLEVTSSSPGDK

SEQ ID NO: 2455 - protein, 517 aa, Brachypodium distachyon
MAPAAASARLLALGAVAILAFAAGSADALRSLGVRDGAGAAAEGDAAVDLNATNFDAFLKASRESFAVVEFFAHWCPACRNYKPHYEKVAKLFNGPDAAHPGRILMARVDCASKVNVDLCSRFSVDHYPFLLWGPPAKFASAKWDRKQEKSEIKLIDDGRTAERLLKWINKQLESSFTLDDKKYENESTLPKNASDPAQVVQAIYDVEEATAHALQIILEHKMIKSETRDSLVRFLQILVAHHPSKRCRRGSAELLINFDDHWPSNLSLSSPESSKLLENVAAENHKICGKEVPRGYWMFCRGSKSETRGFSCGLWVLLHSLTVRIGDGESQSTFTSICDFIHNFFICEECSRHFYEMCSSVSVPFKSARDLSLWLWSTHNKVNARLMKEEHDLGTGDPSFPKVIWPPKPLCPSCYRSSSKTGDGAVQVDWNEDEIFPFLVNYYGKTLVSSYKETYMESLQEKKQVGLVSDDSPSLSAARVPIGAALGVAIASCTFGALACFWRAQQKNRKQRKNWN

SEQ ID NO: 2456 - protein, 363 aa, Sorghum bicolor
MAERRSNGGFASQSSHLAAMMRGSYAPQSLWRPSSTSMPMPVGGAAVVASAPAEKNKKSFAADFLLGGVSSSVSKTVAAPIERVKMLLQNQDELIRTGRLSEPYRGIGDCFGRTVRDEGVLSLWRGNTTNVIRYFPTQALNFAFKDYFKSLFNFNRDRDGYWRWFAGNIVSGSAAGATSLLFVYSLDYARTRLTNDYKAAAAMGKGGERQFTGLVDVYRKTLRSDGVAGLYRGFNVSVVGIVVYRGLYFGMYDSFKPVLLTGKLQDNFFASLALGWMITNGANLASYPLDTVRRRMMMTSGEAVKYKSSMDAFAQIVRNEGPRSLFKGAGANVLRAIAGAGALAGYDQLQLIFFGKKYGSGGA

SEQ ID NO: 2457 - protein, 335 aa, Triticum aestivum
MVRTTVQDLAAAVEEPPRQYVVRTSETENHLLAADEMPDPIPLIDLGRLTRPAADEAHKLREALQTWGLFLVTNHGIEESLMDAMMSASRDFFRQPPEEKNKCSNLIDDGGRHLEVEGYGNDKVVTPQDQGLSWNDRLHLRVEPEDERNFAKWPTHPESFRDVLLEYATRTKRIRDLILRSIAKILDLDEDYFVNQISNKARGFARFNYYPPCPRPDLVLGMRPHSDVGLLTILSVDHDVGGLQVQRDGKWYNVPAKPYTLVINLADCMEIMCNGIFMSPVHRVVTNAKKERLSLGVFYVVDGEMVLEPAPGLLDDERPPRYGKFKANDFGFSFD

SEQ ID NO: 2458 - protein, 334 aa, Triticum aestivum
MVRTTVQELAAAVEEPPRQYVVAHEQDQDLLAADEMPEPILLIDLSRLTTADAADEADKLRAALQTWGLFLVTNHGIEESLMDAMMSASREFFRQPSGEKQKCSNLIDDGGKHSEVEGYGNDKVVNQDESLSWNDRLHLRVEPEDERNFTKWPTHPESFRDVLLEYASRTKRIRDVVFRTIAKLLDLDEDYFLNQMSNKDPGFARFNYYPPCPRPDLVLGMRPHSDAGLLTILFVDRDVGGLQVERDGKWYNVPAKPYSLVINLADCMEIMCNGIFRSPVHRVVTNAEKERLSLAVFYAVDGETVLEPAPGLLDDERPPRYGKFKAKDFGLSFD

SEQ ID NO: 2459 - protein, 334 aa, Triticum aestivum
MVRTTVQELAAAVEEPPRQYVVAHEQDQGLLAADEMPEPIPLIDLSRLTTAAAADEADKLRAALQTWGLFMVTNHGIEESLMDAMMSASREFFRQPSEEKQKCSNLIDGGGKHSEVEGYGNDEVVNQAEGLSWNDRLHLRVEPEDERNFTKWPAHPKSFRDVLLEYASRTKRIRDLVFRSIAKLLDLDEDYFLNQISSKDPGFARFNYYPPCPRPDLVLGMRPHSDAGLLTILFVDHDVGGLQVERDGRWYNVPAKPYSLVINLADCMEIMCNGIFRSPVHRVVTNAERERLSLAVFYAVDGETVLEPAPGLLDDERPARYGKFKAKDFGLSFD

SEQ ID NO: 2460 - protein, 172 aa, Oryza sativa
MPSLLLVFLVASSAAGVAAGGGGGELKHIHLYMHETFSGPNATEGGVVASPFNTTFGQVAVFDNELRTGEDRAASPLVGRYQGFIVGTGRSSPGYLTSATVAFTAGELNGSTLSLEGPFFGFAGTAERSIVGGTGKLRLARGYYLLKLIGKTSPETAVSEIDFFVLMYSSTH

SEQ ID NO: 2461 - protein, 328 aa, Brachypodium distachyon
MASKQMEEIQRKLALLAYPRAKAPAQSLLFAGVERYRLLEWLFFRLLGDRSPFTQQNWQGDSLDRDEENSRIQHLAEIANFLGITPSVDTEAIQGRGSYDERVELLRLIVDLVEASCYADNPEWSVDEQLAKDVQLVDSIAEKQAQIFSEECKLFPADVQIQSIYPLPDIAELELKLSEYTKKMSNLQQMVQELASKYDYNPNEDYAETELKLREYLQSFLETVKSFNMIYTKEIHPWTHMMEVPQLHGFGPAANRLLEAYNTLLKFLGNLRSLRDSYSAMAAGSLSNSNEPSSVTKIISDCESALTFLNNSLAILSTSVAREQGETL

SEQ ID NO: 2462 - protein, 328 aa, Zea mays
MASKQMEEIQRKLSLLEYPRANAPAQSLLFAGVERYRLLEWLFFRLLGDRSPFTQQNWQGDSLDRDEENNRIQHLAEIANFLGITPSADTEAIQGRGSYEERVELLHLIVDLVEASCYADNPEWSVDKQLEKDVQLVDSIAEKQAQIFSEECKLFPADVQIQSIYPLPDIAELELKLSEYTKKMSNLQQMVQELASKYDYNPNEDYAETELKLREYLQSFLETVKSFNTIYTKEIHPWTHMMEVPQLHGFGPAANRLLEAYNTLLKFLGNLRSLRDSYTAMAAGSLSASNEPSSVTKIISDCESALTFLNHSLSILSTSVAREQGGTL

SEQ ID NO: 2463 - protein, 328 aa, Sorghum bicolor
MASKQMEEIQRKLSLLEYPRANAPAQSLLFAGVERYRLLEWLFFRLLGDRSPFTQQNWQGDSLDRDEENNRIQHLAEIANFLGITPSVDTEAIQGRGSYEERVELLHLIVDLVEASCYADNPEWSVDKQLEKDVQLVDSIAEKQAQIFSEECKLFPADVQIQSIYPLPDIAELELKLSEYTKKMSNLQQMVQELASKYDYNPNEDYAETELKLREHLKSFLETVKSFNTIYTKEIHPWTHMMEVPQLHGFGPAANRLLEAYNTLLKFLGNLRSLRDSYTAMAAGSLSASNEPSSVTKIISDCESALTFLNHSLSILSTSVAREQGETL

SEQ ID NO: 2464 - protein, 328 aa, Saccharum officinarum; identical to SEQ ID NO: 2463

SEQ ID NO: 2465 - protein, 328 aa, Panicum virgatum
MASKQMEEIQRKLSLLANPRANAPAQSLLFAGVERYRLLEWLFFRLLGDRSPFTQQNWQGDSLDRDEENNRIQHLAEIANFLGITPSVDTEAIQGRGSYEERVELLRLIVDLVEASCYADNPEWSVDEQLAKDVQLVDSIAEKQAQIFSEECKLFPADVQIQSIYPLPDIAELELKLSEYTKKMSNLQQMVQELASKYDYNPNEDYAETELKLREHLQSFLETVKSFNTIYTKEIHPWTHMMEVPQLHGFGPAANRLLEAYNTLLKFLGNLRSLRDSYTAMAAGSLSASNEPSSVAKIISDCESALTFLNHSLSILSTSLAREQGETL

SEQ ID NO: 2466 - protein, 90 aa, Triticum aestivum
MASKQMEEIQRKLALLAYPRASAPAQSLLLRRRRALPPPRVALLPAAGRQIAVHPAELAGGQPRPRRGEQQDPALGGDREFPRYHAFGRH

SEQ ID NO: 2467 - protein, 528 aa, Brachypodium distachyon
MAAWWEEIVAAVSTSGPGGSSGTVVSICVFTAVLCLCLVAGHLLEENKWVNESITALIIGCIVGAFIFLLSKGRNSHILRFDEQLFFIYVLPPIIFNAGFQVKKKQFFHNFLTIMSFGVVGVFISVAIVSAGCHWLFPKVGFGKLDAVDYLALGTIFSSTDTVCTLQVISQDETPRLYSLVFGEGVVNDATSVVLFNAIKNLDINRLKRGVVLKVIADFLYLFATSTILGATIGLATAYVLKALYFGRHSTDREVALMALMAYLSYMLAELLSLSGILTVFFCGIVMSHYAWHNVTESSRITTRHIFATLSFIAETFIFLYVGMDALDIDKWKTSQASFKTSIGIFGIIISLVLLGRAAFVFPLSILSNFMSGNSEKAPITFKHQVVIWWAGLMRGAVSIALAYNQFTFSGVTLDPVHAAVITTTIVVVFFTTLVFGFLTRPLISAMLPQQRHREGTGGHITSSNSPKDEFILPFLSDENAPGSESGINQAKRSISMLLERPVHMVHIHWRKFDDKFMRPIFGGPLSY

SEQ ID NO: 2468 - protein, 196 aa, Pennisetum glaucum
IHLLMLVWMPLTLINGRHRRQASRHPSVSWYHHPARVTGTSRICFPYIHLSNNMSGSSERTPITFKHQVVIWWAGLMRGAVSIALAYNQFTFSGVTSDPVHATIITSTIIVVFFTTLVFGFLTRPLISTMLPHHSRTLSRGHSTGSNSPKDDFTLPFFSTDEDASGTRYRLGASQEKHIYTAGETCPHGSHLLEEV

SEQ ID NO: 2469 - protein, 530 aa, Sorghum bicolor
MAAALWETLLAASAADGTGGSSTTVVSICVFTAVLCLCLVAGHLLEENKWVNESITALIIGCIVGAIIFLLTEGKHSHILRFDEQLFFIYVLPPIIFNAGFQVKKKQFFHNFMTIMSFGVFGVFISGAIVSAGCYWLFPKVGFGKLDAVDYLALGAIFSSTDTVCTLQVINQDETPRLYSLVFGEGVVNDATAVVLFNAIKNLDISQLKGGVVLKLIADFLYLFATSTIIGISIGLATAYVLKALYFGRHSTDREVALMALMAYLSYMLAELLELSGILTVFFCGIVMSHYAWHNVTESSRITTKHIFATLSFIAETFIFLYVGMDALDVDKWKTSKESFKTSIGIFGIVVLLILLGRVAFVFPVSILSNILSGSSERTPITFKHQVVIWWAGLMRGAVSIALAYNQFTFSGVTSDPVHATIITSTIIVVFFTTLVFGFLTRPLISAMLPHQSRALSRGHSTGSNSPKDDDLALPFLSSDEGASGSGIVLEQAKRSLSMMLERPVHTVHVYWRKFDDRFMRPIFGGPQSY

SEQ ID NO: 2470 - protein, 527 aa, Panicum virgatum
MSAAAWWEALAAVGGTAGSSTTVVSICVFTAVLCLCLVAGHLLEENKWVNESITALIIGCLIGAIIFLLTKGKQSHILRFDEQLFFIYVLPPIIFNAGFQVKKKQFFHNFMTIMSFGVFGVFISVAIVSAGCYWLFPKVGFGELDASDYLALGAIFSSTDTVCTLQVINQDETPRLYSLVFGEGVVNDATAVVLFNAIKNLNISQLKGRVVLKVISDFLYLFATSTILGISIGLSTAYILKALYLGRHSTDREVALMALMAYLSYMLAELLDLSGILTVFFCGIVMSHYAWHNVTENSRITTKHIFETLSFIAETFIFLYVGMDALDIDKWKTSKASFKTSISIFGIIILFVLLGRAAFVFPISILSNNMSGSSERTPITFKHQVVIWWAGLMRGAVSIALAYNQFTFSGVTSDPVHATIITSTIIVVFFTTLVFGFLTRPLISAMLPRHSRALPRGHSTGSNSPKDDFTLPFFSTDEDASGSGIVLEQAKRSISMLLERPVHTVHIYWRKFDDKFMRPIFGGPQSH

SEQ ID NO: 2471 - protein, 135 aa, Panicum virgatum
MRGAVSIALAYNQFTFSGVTSDPVHATIITSTIIVVFFTTLVFGFLTRPLISAILPSPSSALSRGHSTGSNSPKDDFVLPFLSSDEGASGSSIVLEQAKRSLSMMLERPVHTVHIYWRKFDDRFMRPIFGGPQSY

SEQ ID NO: 2472 - protein, 557 aa, Triticum aestivum
DYRGSEEEGGQGGGGDLKPNRSELCICARHMAASSLWDELVVAASTGGSSGTVVSICVFTAVLCLCLVAGHLLEENKWVNESITALIIGCIVGALIFLLSKGRNSHILRFDEQLFFIYVLPPIIFNAGFQVKKKQFFHNFLTIMSFGVFGVFISVAIVSAGFYWLLPKVGFGKLDAVDYLALGVIFSSTDTVCTLQVISQDETPRLYSLVFGEGVVNDATSVVLFNAIKNMDITKIKSRAVLKVIGDFLYLFATSTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMDKWKTTQASFKTSIGIFGVIISLILLGRAAFVFPLSILSNFMSGNSEKAPITFKHQVVIWWAGLMRGAVSIALAYNQFTFSGVTQDPVHATIITSTIVVVFFTTLVFGFLTRPMISAMLPQHRHREPTGGRSTGSNSPKDEFILPFLGDEDASGSGSGFVQAKRSISMMLERPIHTVHIYWRKFDDRFMRPIFGGPRSY

SEQ ID NO: 2473 - protein, 290 aa, Musa acuminata
  misc_feature (286)..(286): Xaa can be any naturally occurring amino acid
MVNTFFVFCACIDQASIGVVEQWGRFLSLAGPGLHFFNPFAGECLAGVLSTRVSSLDVRVETKTKDNVFVQLVCSIQYRVVKENADDAFYELQNPQEQIQAYVFDVVRAHVPRMTLDELFEQKGDVAKAVLEELEKVMGGYGYNIEQILMVDIIPDASVRRAMNEINAAQRLQLASVYKGEAEKVLMVKKAEAEAEAKYLSGVGIAKQRQAITDGLRDNILNFSNTVSGTSAKEVMDLIMVTQYFDTIKELGNSSKNTTVFIPHGPGHVRDVTDQIRNGVMEASSXLVGN

SEQ ID NO: 2474 - protein, 288 aa, Brachypodium distachyon
MVSAFFVFCGCVEQANVAVVEKWGRFLRLAEPGLHFFNPFAGEFVAGTLSTRVQSLDVRVETKTKDNVFVQLICTIQYRVVKENADDAFYELQNPQQQIQSYVFDVVRAIVPRMELDSLFEQKNEVAKSVLEELGKVMSDYGYSIEHILMVDIIPDAAVRRAMNDINAAQRLQLASVYKGEAEKILMVKKAEGEADAKYLSGVGIAKQRQAITDGLRENILNFSHTVSGTSAKEVMDLIMVTQYFDTIKELGDNSKNTTVFLPHGPGHVRDISDQIRNGVMEASSSNV

SEQ ID NO: 2475 - protein, 288 aa, Leymus cinereus x Leymus triticoides
  misc_feature (216)..(217): Xaa can be any naturally occurring amino acid
MVSAFFLFCGCVEQANVAVVEKWGRFLRLAEPGLHFFNPCAGELVAGTLSTRVQSLDVKVETKTKDNVFVQLICTIQYRVVKENADDAFYELQNPQQQIQSYVFDVVRAIVPRMELDSLFEQKNDVAKDVLEELEKVMSDYGYSIEHILMVDIIPDAAVRRAMNDINAAQRLQLASVYKGEAEKIHLVKKAEGEAEAKYLSGVGIAKQRQAITDGXXENILNFSHSVSGTSAKEVMDLIMVTQYFDTIKELGDNSKTTTVFIPHGPGHVKDIGDQIRNGMMEASSSGL

SEQ ID NO: 2476 - protein, 288 aa, Zea mays
MVNTFFLFCGCVDQASVAVVEKWGRFLRLADPGLHFFNPLAGECVAGSLTTRVQSLDVRVETKTKDNVFVQLICTIQYRVVKENADDAFYELQNPQQQIQAYVFDVVRAIVPRMNLDDLFEQKNDVAKAVLEELEKVMADYGYSIEHILMVDIIPDAAVRKAMNDINAAQRLQLASVYKGEAEKILMVKKAEAEAEAKYLSGVGIAKQRQAITDGLRENILNFSHSVSGTSAKEVMDLIMVTQYFDTIKELGDGSKNTTIFIPHGPGHVKDISEQIRDGMMQASSSNV

SEQ ID NO: 2477 - protein, 302 aa, Cucumis melo
MGNTNCVLFGCVEQSSVGVVERWGRFEKLAQPGLHFFNLFAGECLAGTLSTRISSLDVRIETKTKDNVFVQLLCSIQYRVVKENADDAFYELQNPQEQIQAYVFDVVRAVVPKMNLDELFEQKGEVAKAVSEELEKVMGDYGYSIEHILMVDIIPDASVRRAMNEINAAQRLQLASVYKGEAEKVLLVKKAEAEAEAKYLGGVGVARQRQAITDGLRENILNFSHKVEGTSAKEVMDLILITQYFDTIKDLGNSSKNTTVFIPHGPGHVRDISGQIRNGMMEAAASAQARVTNDEVNIDLLQ

SEQ ID NO: 2478 - protein, 86 aa, Pennisetum glaucum
GRFVRLAEPGLHFFNIFAGEYIAGTLTTRVQSLDVRVETKTKDNVFVQLICTIQYRVVKQNADDAFYELQNPQQQIQAYVFDVFGP

SEQ ID NO: 2479 - protein, 288 aa, Pseudoroegneria spicata
MVSAFFLFCGCVEQANVAVVEKWGRFLRLAEPGLHFFNPCAGELVAGTLSTRVQSLDVKVETKTKDNVFVQLICTIQYRIVKENADDAFYELQNPQQQIQSYVFDVVRAIVPRMELDSLFEQKNDVAKAVLEELEKVMSDYGYSIEHILMVDIIPDAAVRRAMNDINAAQRLQLASVYKGEAEKIHLVKKAEGEAEAKYLSGVGIAKQRQAITDGLRENILNFSHSVSGTSAKEVMDLIMVTQYFDTIKELGDNSKTTTVFIPHGPGHVKDIGDQIRTGMMEASSSGL

SEQ ID NO: 2480 - protein, 288 aa, Oryza sativa
MVSAFFLLCGCVDQASVAVVEKWGRFLRLAEPGLHFFNPFAGEFVAGTLSTRVQSLDVRVETKTKDNVFVQLICTIQYRVVKEHADDAFYELQNPQQQIQAYVFDVVRAIVPRMNLDDLFEQKNDVAKAVLQELEKVMGDYGYSIEHILMVDIIPDAAVRRAMNEINAAQRLQLASVYKGEAEKILLVKKAEAEAEAKHLSGVGIARQRQAITDGLRENILNFSHSVSGTSAKEVMDLIMVTQYFDTIKELGDGSKNTTVFIPHGPGHVRDISEQIRNGMMEASCSNV

SEQ ID NO: 2481 - protein, 288 aa, Sorghum bicolor
MVNAFFLFCGCVDQASVAVVEKWGRFLRLADPGLHFFNPFAGECVAGALTTRVQSLDVRVETKTKDNVFVQLICTIQYRVVKENADDAFYELQNPQQQIQAYVFDVVRAIVPRMNLDDLFEQKNDVAKAVLEELEKVMAAYGYSIEHILMVDIIPDAAVRKAMNEINAAQRLQLASVYKGEAEKILMVKKAEAEAEAKYLSGVGIAKQRQAITDGLRENILNFSHSVSGTSAKEVMDLIMVTQYFDTIKELGDGSKNTTIFIPHGPGHVKDISEQIRDGMMQASSSNV

SEQ ID NO: 2482 - protein, 292 aa, Glycine max
MGNTFCLFCGCVAQSSVGVVEQWGRFHRLAQPGFHFFNPLAGECLSGILSTRISSLDVRIETKTKDNVFVQLLCSIQYRVIKENADDAFYELQNPQEQIQAYVFDVTRAIVPRMNLDELFEQKGEVAKAVLEELEKVMGEYGYSIEHILMVDIIPDPAVRKAMNEINAAQRMQLASQYKGEAEKILLVKKAEAEAEAKYLGGVGVARQRQAITDGLRENILNFSHKVEGTNAKEVMDLIMITQYFDTIKDLGNSSKNTTVFIPHGPGHVRDIGEQIRNGLMEAASAQVNVEE

SEQ ID NO: 2483 - protein, 288 aa, Saccharum officinarum; identical to SEQ ID NO: 2481

SEQ ID NO: 2484 - protein, 288 aa, Panicum virgatum
MVNSFFVFCGCVDQASVAVVEKWGRFVRLAEPGLHFFNPFAGECVAGSLTTRVQSLDVRVETKTKDNVFVQLICTIQYRVVKENADDAFYELQNPQQQIQAYVFDVVRAIVPRMNLDDLFEQKNDVAKSVLEELEKVMADYGYSIEHILMIDIIPDAAVRKAMNEINAAQRLQLASVYKGEAEKVLLVKKAEAEAEAKYLSGVGIAKQRQAITDGLRENILNFSHSVSGTSAKEVMDLIMVTQYFDTIKELGDGSKNTTVFIPHGPGHVKDISEQIRDGMMQASSSNV

SEQ ID NO: 2485 - protein, 288 aa, Triticum aestivum
MVSAFFLFCGCVEQANVAVVEKWGRFLRLAEPGLHFFNPFAGELVAGTLSTRVQSLDVKVETKTKDNVFVQLICTIQYRVVKENADDAFYELQNPQQQIQSYVFDVVRAIVPRMELDSLFEQKNDVAKAVLEELEKVMSDYGYSIEHILMVDIIPDAAVRRAMNDINAAQRLQLASVYKGEAEKIHLVKKAEGEAEAKYLSGVGIAKQRQAITDGLRENILNFSHSVSGTSAKEVMDLIMVTQYFDTIKELGDNSKTTTVFIPHGPGHVKDIGDQIRTGMMEASSSGL

SEQ ID NO: 2486 - protein, 288 aa, Triticum aestivum; identical to SEQ ID NO: 2485

SEQ ID NO: 2487 - protein, 244 aa, Brachypodium distachyon
MCTLEQRGRVFVLTLTGDGEHRLGHALISSIRSALASAAAAAAAQAGPGACLVTVGEGRFFSNGLDIGWAGTSRARLGELVAALRPVAADLLALPMPTVAALTGHASAAGFLLALCHDYRLMRADRGVLYMSEVDIGLPLPPYFMAVLRAKITAAQALRDVVLRGRKLRAPDAKEMGIVDAVCPGAPETAAEALKLAEQLAARKWDGAVYASIRISMYPDACRSVGIVEESDEEKARTFASSKL

SEQ ID NO: 2488 - protein, 221 aa, Lolium multiflorum
MCTLEQHGRVFVLTLTGDGEHRLGHALIASIRAALASVAAQAAQSGPGAALVTVAEGRFFSNGLDIGWAGTSRARLGELVAALRPVAADLLALPMPTVAAVTGHASAGGFLLALCHDYRVMRADRGVLYMSEVDIGLPLPPYFVALFRAKVTAAHALRDVLLRGRKLRAPEAKAMGIVDVVCPGAPETAAEALRLAEELAARKWDGAVYASIRVSCSRCVQ

SEQ ID NO: 2489 - protein, 242 aa, Zea mays
MCTLEQRGRVFVLTLTGDGEHRLGHALISSLRSAVASAAAGAAKAGPGAALVTVGEGRFFSNGLDIGWAGTSRARLGELVDALRPLVADLLALPMPTVAAVTGHASAGGCLLALCHDYRIMRGDRGVLYMSEVDIGLPLPPYFMAVLRAKITAANALRDVVLRGKKVRAAEGKDMGIVDAVYPSALETADQAFKFAEQLAARKWDGGVYASIRMSMYPEACRSVGIVEESDEEKRKHFASKL

SEQ ID NO: 2490 - protein, 244 aa, Pseudoroegneria spicata
MCTLEQRGRVFVLTLTGDGEHRLGHPLIASIRSALAEVLAAAQAQPQGPGAALVTVAEGRFFSNGLDIGWAGTSRARLGELVDALRPVAADLLALPMPTVAAVTGHASAGGFLLALCHDYRVMRADRGVLYMSEVDIGLPLPPYFVHVLRAKISQAQALRDVVLRGKKLRAPEAKEMGVVDVVCPGAPETAAEALKLAEQLAARKWDGAVYASIRMSMFPDACRAVGIAVESDEEKSRHFASRL

SEQ ID NO: 2491 - protein, 242 aa, Oryza sativa
MCTLEQRGRVFVLTLTGDGEHRLGHSLIGSIRAAVSSVAAAAAAAGPGAALVTVAEGRFFSNGLDIGPGGIPPSRVGELVVALRPLAADLLALPMPTVAAVTGHASAGGFLLTLCHDYRLMRADRGVLYMSEIDIGLPLPPYFVAILRAKITAAHALRDVTLRGRKLKAAEAKEMGIVDVVCPTAAETAAEAVKLAEQLAARKWNGNVYSSIRISMFPEACRSVGIVEESDEEKRNHFASKL

SEQ ID NO: 2492 - protein, 242 aa, Sorghum bicolor
MCTLEQRGRVFVLTLTGDGEHRLGHALISSLRSAVASAAEGAAKAGPGCALVTVGEGRFFSNGLDIGWAGTSRARLGELVAALRLLAADLLALPMPTVAAVTGHASAGGCLLALCHDYRIMRGDRGVLYMSEVDIGLPLPPYFVAVLRAKITSANALRDVALRGKKVRAAEGKEMGIVDAVYPSADETAAEAFKFAEQLAARKWDGGVYASIRMSMYPEACRSVGIVEESDEEKRKHFASKL

SEQ ID NO: 2493 - protein, 242 aa, Panicum virgatum
MCTLEQRGRVFVLTLTGDGEHRLGHALISSLRSAVASAAEAAARAGPGAALVTVGEGRFFSNGLDIGWAGTSRARLGELVDALRPLAADLLALRMPTVAAVTGHASAGGFLLALCHDYRLMRADRGVLYMSEVDIGLPLPPYFMAVLRAKITAANALRDVVLRGRKLRAAEGREMGVVDAVYPSAAETAAEAFKFAEQLAARKWDGAVYASIRMSMYPEACRSVGIVEESDEVKRKHFASKL

SEQ ID NO: 2494 - protein, 244 aa, Triticum aestivum
MCTLERRGRVFVLTLTGEDQHRLGHPLIAAIRSALAEVLAAAQAQPQGPGAALVTVAEGRFFSNGLDIGWAGTSRARLGELVDALRPVAADLLALPMPTVAAVTGHASAAGFLLALCHDYRVMRADRGVLYMSEVDIGLPLPPYFVHVLRAKISQAQALRDVVLRGKKLRAPEAREMGVVDVVCPGAPETAAEALKLAEQLAARKWDGAVYASIRMSMFPDACRAVGIAVESDEEKSRHFASRL

SEQ ID NO: 2495 - protein, 244 aa, Triticum aestivum
MCTLEQHGRVFVLTLTGEDQHRLGHPLIAAIRAALASVLAAAQAQPQGPGAALVTVAEGRFFSNGLDIGWAGTSRARLGELVDALRPVAADLLALPMPTVAAVTGHASAAGFLLALCHDYRLMRADRGVLYMSEVDIGLPLPPYFVHVLRAKISQAHALRDVVLRGRKLRAPEAREMGVVDVVCPGAPETAAEALKLAEQLAARKWDGAVYASIRMSMFPDACRAVGIAVESDEEKSRHFASRL

SEQ ID NO: 2496 - protein, 237 aa, Brachypodium distachyon
MAQCLRGKGGAAAVEEALRKAVPWRRAASASYHHTIQAVPRETTGPRAAARERRNGHVPAVLLTLAGAGPGEGVAHRKLLTTDRKQLSEMLKQSPYFLSTPVRLQVRAGERSTAVVHSGTVLPIKVHTDESTGNILNLVMVQADEGTMIKVNLPVVFKGEDVCPGLKKGGFLQKIRTSLVYLCPAEHIPPKIEVDLTNLDIGDRVLMNDIPVHPSLKLLSRNETMPVCKLLASKPVE

SEQ ID NO: 2497 - protein, 239 aa, Zea mays
MAQFLRGKAAAAAGAAVLRASSPAPWRRTASASYHHTIQAVPRETAGPRAAARERRHGRVPAVLLTLAGAAPGNGIAHRHLLTADRRQLAEMLKQSPYFLSTPVRLQVRAGERSNAILHAGTVLPIKVHRDENSGNILNLVMVKADEGTMLKVDLPVEFKGKDACPGLKKGGFLQKIRTSLVYLCPAEHIPPKIEVDLTNLDVGDRVLMHDIPVHPSLKLLSKNETMPVCKILASKPDE

SEQ ID NO: 2498 - protein, 237 aa, Zea mays
MAQCLRGKGGAAAVGEALRKAAPWQRAASASYHHTIQAVPRETAGPRAAARERRNGNVPAVLLTLAGAGPGEGVAHRKLLTTDKKQLAEMLKQSPYFLSTPVRLQVRAGERSTAVVHSGTVLPIKVQTDESTGNILNLVMVEADEGTMLKVNLPVVFKGEDVCPGLKKGGFLQKIRTSLVYLCPAEHIPPKIEVDLTNVDIGDRVLMQDIPVHPSLKLLSKNETMPVCKVLSSKPAE

SEQ ID NO: 2499 - protein, 237 aa, Pseudoroegneria spicata
MAQCLRGKGGAAAVGEALRKAAPWRRAASASYHHTIQAVPRETAGPRAAARERRNGNVPAVLLSLAGSGPGEGVAHRKLLTTDKKQLAEMLKQSPYFLSTPVRLQVRAGERSTAVVHSGTVLPIKVQTEESTGNILNLVMVEADEGTMLKVNLPVVFKGEDVCPGLKKGGFLQKIRTSLVYLCPAEHIPPKIEVDLTNVDIGDRVLMQDIPVHPSLKLLSKNETMPVCKVLSSKPAE

SEQ ID NO: 2500 - protein, 182 aa, Oryza sativa
MALCLRRAAAAAVGEALRRGASTAPWRRAASASYHHTIQALPRETAGPRAAARERRSGRVPAVLLALAGAGPGEGVAHRKLLTADRKQLGEILKQSPYFLSTPVRLQVRAGERSTAVVHSGTVLPIKVHRDETTGNILNLVLVEADEGTMLKVNLPVEFKGEDVCPGLKKENKDQLGVSLPC

SEQ ID NO: 2501 - protein, 240 aa, Sorghum bicolor
MAQFLRGKATAAAAATAAREAAPWRRTASASYHHTIQAVPRETAGPRAAARERRHGRVPAVLLTLAGAAPGNGIAHRQLLTADRRQLAEMLKQSPYFLSTPVRLQVRAGERSNAIVHAGTVLPIKVHRDETSGNILNLVMVKADEGTMLKVDLPVEFKGEDTCPGLKKGGFLQKIRTSLVYLCPAEHIPPKIEVDLTNLDVGDRVLMHDIPVHPSLKLLSKNETMPICKILASKPIEPVE

SEQ ID NO: 2502 - protein, 241 aa, Panicum virgatum
MAQCLRGRAAAAAGMPAPWRRAASASYHHTIQAVPRETSGPRAAARERRHGRVPAVLLALAGAAPGNGVAHRKLLTADRRQVAEMLKQSPYFLSTPVRLQVRAGERSNAVVHSGTVLPIKMHRDETTGNILNLVMVQADEGTMLKVNLPVEFKGEAACPGLKKGGFLQKIRTSLVYLCPAEHIPPKIEVDLTYLDVGDRVLMHDIPVHPSLKLLSKNETMPVCKILASKPVESETMHDLKS

SEQ ID NO: 2503 - protein, 245 aa, Triticum aestivum
SARGRTQRMAQCLRGKGGAAAVGEALRKAAPWRREASASYHHTIQAVPRETAGPRAAARERRNGNVPAVLLTLAGAGPGEGVAHRKLLTTDKKQLAEMLKQSPYFLSTPVRLQVRAGERSTAVVHSGTVLPIKVQTDESTGNILNLVMVEADEGTMLKVNLPVVFKGEDVCPGLKKGGFLQKIRTSLVYLCPAEHIPPKIEVDLTNVDIGDRVLMQDIHVHPSLKLLSKNETMPVCKVLSSKPAE

SEQ ID NO: 2504 - protein, 81 aa, arabidopsis lyrata
MEGLIPLVYKAVMQIRYGNESQQLSSSYYVRLPGDSGRFGRSDFDVSGLGSSSNTASSSTTTTTFAVYTGVQSPVSRQVVT

SEQ ID NO: 2505 - protein, 276 aa, arabidopsis lyrata
MSNGPGLFTDIGKKAKDLLTRDYNSDQKFSISTYSASGVALTSTALKKGGVHAADVATQYKYKNALFDVKIDTDSSVLTTVTLTEILPSTKAIASFKVPDYNSAKLEVQYFHDHATVTAAAALKQNPLIDITATLGSPVISFGAEAGYDTTSKTFTKYNAGISVTKPDACLSIILGDKGDSLKASYLHHFDEFKRTAAVGEVYRKFSTNENTITVGGLYAIDHSTSVKAKLNNHGTLGALLQHEVLPRSLVTVSSEIDTKALEKHPRFGLSLALKP

SEQ ID NO: 2506 - protein, 109 aa, Brassica napus
MATNKIVRLIAPSRSASSRFLEPVSRFLSSGTPPPQPPQSPSPSPNEDQVVKPDQKLQENLQMPKEEEDEEEGGGGEFFNKDTGEIGGPRGPEPTRYGDWEQRGRCSDF

SEQ ID NO: 2507 - protein, 109 aa, Brassica napus
MATNKIVRLIAPSRSASSRFMEPVSRFLSSGTPPPQSPSPSPNEDQVVKPDQKLQENLQMPKEEEDEEEGGGGGGGEFFNKDTGEIGGPRGPEPTRYGDWEQRGRCSDF

SEQ ID NO: 2508 - protein, 68 aa, Raphanus sativus
MATNKIVRLIAPSRSASSRFLEPVSRFLSSGTPPPPPQSPSPSPNRDQVVKPDQKLQEKRKEEEEEEE

SEQ ID NO: 2509 - protein, 107 aa, Raphanus sativus
  misc_feature (27)..(27): Xaa can be any naturally occurring amino acid
MATNKIVRLIAPSRSASSRFLEPVSRXLSSGTPPPPPQSPSPSPNQDQVVKPDQKLQENTKEEEEEEEEEGGGGEFVNEDTGEIGGPRGPEPTRYGDWEQRGRCSDF

SEQ ID NO: 2510 - protein, 197 aa, Brachypodium distachyon
MAARKELSSTLRNLKFMQRAAVAQKIEDKTEVDVEVEAEVLTPAANGGFGSSARVARKCVVVMEGNPHPGAVKGRMSFQNFNPSIDKLNEEASGHQTQSASPSNSQEDGANPSRTDDVSASRFRGFNVDSSESISLNDLKRKEPELEMETPRSQKLPKTTGQNVDGESSSQSNGRGSRKSNKHEKLDWNLLRRRKSK

SEQ ID NO: 2511 - protein, 200 aa, Triticum aestivum
  misc_feature (98)..(98): Xaa can be any naturally occurring amino acid
  misc_feature (148)..(148): Xaa can be any naturally occurring amino acid
MSAKKGLSSTLRNLKFMQRAAVAQKIEDKADVEVEEPAAEVVMTPAANGGGVGSSVQVARKCVVVMEGNPLPGAVKGRMSFQNFNPSIDKLNDEASGXPTQSASPSNSQQDSANTSRVDDISASRFRSFNVDSSESISLNELKRKEPXLEMETPPSRKLPKTTGQNVDGQPSSQSNGRGSGKSNKHEKLDFNLLRKRKSK

SEQ ID NO: 2512 - protein, 200 aa, Triticum aestivum
MSAKKGLSSTLRNLKFMQRAAVAQKIEDKADVEVEEAAAEVVMTPAANGGGVGSSVQVARKCVVVMEGNPLPGAVKGRMSFQNFNPSIDKLNDEASGRPTQSASPSNSQQDSANTSRVDDISASRFRSFNVDSSESISLNELKRKEPELEMETPPSRKLPKTAGQSVDGQPSSQSNGRGSGKSNKHEKLDFNLLRKRKSK

SEQ ID NO: 2513 - protein, 101 aa, Secale cereale
MAATEAQLLQPRALAALLVVLVLITLGGAAEAQQGTCGAQLSQLAPCARYSVPPLPGQALPTPGPECCSALGSVSRDCACGAIDIINSLPAKCGLPRVSCQ

SEQ ID NO: 2514 - protein, 103 aa, Triticum aestivum
MAVTTAQLPQPRALAALLVLVLLITLGGAAEAQPPLGTCGAQLSQLAPCARYSVPPLPGQALPTPGPECCSALGSVSRDCACGAIDIINSLPAKCGLPRVSCQ

SEQ ID NO: 2515 - protein, 134 aa, Triticum aestivum
TRPRRKSHTHTNAFSFISQASSSARTEPATTMMAVTTAQLPQPRALAALLVLVLITLGGAAEAQPPLGTCGAQLSQLAPCARYSVPPLPGQALPAPGPECCSALGSVSRDCACGAIDIINSLPAKCGLPRVSCQ

SEQ ID NO: 2516 - protein, 110 aa, Triticum aestivum
MEPASASLVSLRASTATSRSCFSCQQRATPRTRMLPAMASKSGAKLVASGCKTCRGKGAVECEGCKGTGRNKKNGNIFERWKCFDCQGFGMRKCPTCGKGGLTPEQRGER

SEQ ID NO: 2517 - protein, 110 aa, Triticum aestivum
MEPASASLVSLRASAATSHSCFSCRQRATPKTRMLPAMASKSGAKLVASGCKTCRGKGAVECEGCKGTGRNKKNGNIFERWKCFDCQGFGMRKCPTCGKGGLTPEQRGER

SEQ ID NO: 2518 - protein, 123 aa, Triticum aestivum
KLGRFLRQAAAAAMEPASASLVSLRASTATSRSCFSCRQRATPRTRMLPAMASKSGAKLVASGCKTCRGKGAVECEGCKGTGRNKKNGNIFERWKCFDCQGFGMRKCPTCGKGGLTPEQRGER

SEQ ID NO: 2519 - protein, 134 aa, Triticum aestivum
FALCIALHRAVKLGRFLRQAAAAAMEPAGASLVSLRASTATSRSCFSCRQQGTPKTRMLPAMASKSGAKLVASGCKTCRGKGAVECEGCKGTGRNKKNGNIFERWKCFDCQGFGMRKCPTCGKGGLTPEQRGER

SEQ ID NO: 2520 - protein, 115 aa, Triticum aestivum
AAAAAMEPASASLVSLRASAATNHSCFSCWQGATPKTRMLPAMASRSGAKLVASGCKTCRGKGAVECEGCKGTGRNKKNGNIFERWKCFDCQGFGMRKCPTCGKGGLTPEQRGER

SEQ ID NO: 2521 - protein, 294 aa, Brachypodium distachyon
MSSPPQSRQAPTYQLLLLLLLFFSPIASAGQPKGVCVSPGGRFPAFSSEGKPPGRAAKGRRDLALCRLFRQNTCCDVTQTFPALLSVRKLSSTGEGSGECLHLWELLECSVCDPWVGVRPGPPVICASFCDMVFEACSEAYFSVDTKTQALSPCGLGDILCGKAHKWVSNGTELCRLAGFAVQVSEASPTEVDETFCYGGKASLDSISDTWTSSKDRPTLRGVTSWDLEDFQRWATQMPVGERISWAIGGMVLTAGLFISKREGYSRRRKQASVAETVRRRWNQELTCSQLKRS

SEQ ID NO: 2522 - protein, 160 aa, Triticum aestivum
  misc_feature (78)..(78): Xaa can be any naturally occurring amino acid
  misc_feature (91)..(91): Xaa can be any naturally occurring amino acid
  misc_feature (108)..(108): Xaa can be any naturally occurring amino acid
MVFEACSEAYFSIDTKTQALSPCGLGDILCGKAHKWVSNGTELCRLAGFSVQVSDASPSEVVETFCYGGKASLDSISXTWTSSKDRPVLHXMASWDLEDFQRWAKEMXVGERISWAVGGMVLTAGLIFISKREGYSRRRKQASVAQTVRKKWNRELTRSN

SEQ ID NO: 2523 - protein, 366 aa, Triticum aestivum
MELIDSGLALMEISMGESSTKTRMKSIREAEQTNLRRIRELQERIRRRQEQLVRDPQPPLRYEFEKAPTDEQEAEDYRQMREMCFRLNFGSIDGETSLGPICCTTGTNPADALPESCMQIFSIKVTDLNNDLSLPLEVHGFVAARDSVDRKRNYLFRCTRDNCQTLTPKDPFLHLTGPSRAVLLIDLVAIEVQLKVKGKKESEDEVLAFKCFYFHERYHLEDGIRFRIPSKRCMLEFALAVLPMSVEAIVGIRVVDGSWPDHCPGLVVCSTNSVKEGKVVLLDFQNGELPTKSDGVVELARRVVSVDYPEGKLTVSVEASRGRFSARGTVDFGMKVPRGSAARTCDLVFCKMLVTVAWSLVSCYRV

SEQ ID NO: 2524 - protein, 227 aa, Sorghum bicolor
MRVADHGTKQTDRVNQSGELCVCGAGCVCARVRHGDHARPWRRRRIGVEGRRRGRRPGRGLGLGRHPAAPLLRLPLPLLRSRGCFGCCDKTVKQLGELSRNLITHDQITIGEPYWSTTTIEVEPADLRGVSPMSTSNWAFDQHGTGSSHNLPGLGNNGLILWEQTRQEWTEIRSLRPKVKQVREPVLSWNAAYESLLGSNKPFPQPIPLHEMVDFLVDIWEQEGLYD

SEQ ID NO: 2525 - protein, 192 aa, Saccharum officinarum
  misc_feature (57)..(57): Xaa can be any naturally occurring amino acid
DHARPWRRRRIGVEGRRWGRRPGRGLGLGRHPAAPLLRLPLPLLRSRGCFGCCDKTXKQLGELSRNLITHDQITIGEPFWSTTTIEVEPADLRGVSSISTSNWAFEQHGTGSSHNLPGLDNNGLVLWEQTRQEWTEIRSLRPKVKQVREPVLSWNAAYESLLGSNKPFPQPIPLHEMVDFLVDIWEQEGLYD

SEQ ID NO: 2526 - protein, 189 aa, Panicum virgatum
MATTRGGGGSASRVGDGDVDLGEGWNWGAIPRLISSACLFLCSGGCFGCCDKAVKQLGELSRNLITHDQIPIGETFWSTTTIEVEPADLRGISPVNASNWAFDQHGTGSSHNLPELGNNGLVLWEQTRQEWTEIRSLRPKVKQVREPVLSWNAAYESLLGSNKPFPQPIPLHEMVDFLVDIWEQEGLYD

SEQ ID NO: 2527 - protein, 341 aa, Hordeum vulgare
MASSRGGAGALVLAFVTVAVLVSPALSAPLDGAGFHSATCPQLESIVLSSVQAALQRDVALAAGLLRIFFHDCFPQGCDASVYLKGRGTEQTMGPNTTLQPRALQLVEDIRAKVHAACGPTVSCADISALATRDAVVLSGGPNYTVPQGQFDSLAPASENVVDGLPSPATDSVTILARAFRAKGLRDLADLVALSGAHTVGRTGCPFFADRAQRMDDAFSRRLAANCSAAPNRLQNLDVVTPDLFDNGYYKALVNSQGVFTSDMALIKDRTTAPIVRQFARSKDAFFAQFAKSMAKLATAPRPGGNVGEIRRSCFSRNARRAIDTVVDASAGDEEGFAASA

SEQ ID NO: 2528 - protein, 337 aa, Pseudoroegneria spicata
RLPCSRSALVLAFVAVAVLVSPALSAPLDGAGFHSATCPQLESIVLSSVQAALQREVALAAGLLRIFFHDCFPQGCDASVYLKGSGTEQAMGPNTTLQPRALQLVEDIRAKVHAACGATVSCADISALATRDAVVLSGGPNYTVPQGQFDSLAPASQNAVNALPSPATASVSALARAFSAKGLRDLADLVALSGAHTVGRTGCPFFADRAQRMDDTFSRRLAANCSAAPSRLQNLDVVTPDLFDNGYYKALVNSEGVFTSDMALIKDRTTAPIVRQFAQSKDAFFTQFAKSMAKLATAPRPGGNVGEIRRSCFSRNPRRAIDTVVEAGEEEGFAASA

SEQ ID NO: 2529 - protein, 341 aa, Triticum aestivum
MAMASSSNGAGTVVLAFVTVAVLVSPALSAPLDGAGFHSATCPQLESIVLSSVQAALQREVALAAGLLRIFFHDCFPQGCDASVYLKGSGTEQAMVPNATLQPRALQLVEDIRAKVHAACGATVSCADISALATRDAVVLSGGPNYTVPQGQFDSLAPASENAVNALPSPATSSVSALARAFSAKGLRDLADLVALSGAHTVGRTGCQFFRDRAQRMDDAFSRRLAANCSAAPSRLQNLDVVTPDLFDNGYYKALVNSQGVFTSDMALIKDRTTAPIVRQFAQSKDAFFAQFAKSMAKLAAAPRPGGNVGEIRRSCFSPNAPRAIDTVVDAGDEEGFAASV

SEQ ID NO: 2530 - protein, 341 aa, Triticum aestivum
MAMASSSGGAGALVLAFVTVAVLLSPALSAPLDGAGFHSATCPQLESIVLSSVQAALQREVALAARLLRIFFHDCFPQGCDASVYLKGSGTEQAMGPNTTLQPRALQLVEDIRAKVHAACGATVSCADISALATRDAVVLSGGPNYTVPQGQFDSLAPASQNAVNALPSPATSSVSALARAFSAKGLRDLADLVALSGAHTVGRTGCPFFRDRAQRMDDAFSRRLAANCSAAPTRLQNLDVVTPDLFDNGYYKALVNSQGVFTSDMALIKDRTTAPIVRQFAQSKDAFFAQFAKSMAKLATAPRPGGNVGEIRRSCFSPNARRAIDTVVDAGEEEGFAASA

SEQ ID NO: 2531 - protein, 341 aa, Triticum aestivum
  misc_feature (209)..(209): Xaa can be any naturally occurring amino acid
MAMASSSGGAGALVLAFVTVAVLLSPALSAPLDGAGFHSATCPQLESIVLSSVQAALQREVALAAGLLRIFFHDCFPQGCDASVYLKGSGTEQAMGPNTTLQPRALQLVEDIRAKVHAACGATVSCADISALATRDAVVLSGGPNYTVPQGQFDSLAPASANVVDGLPSPRTASVSTLARAFSAKGLRDLADLVALSGAHTVGRTGCPXFSDRAQRMDDAFSRRLAANCSAPSPRPQNLDVVTPDLFDNGYYKALVNSQGVFTSDMALIKDRTTAPIVRQFAQSKDAFFAQFAKSMAKLATAPRPGGNVGEIRRSCFSRNARRAIDTVVDAGDEEGFTASA

SEQ ID NO: 2532 - protein, 131 aa, Brachypodium distachyon
MAQGTLEVLLVGAKGLENTDFLSNMDPYAVLICTSQEQKSTVASGKGSDPEWNETFVFTVSENATELIIKLLDSDNGTEDDCVGEATIPLEAVYTEGSISPTVYNVVKDEEYRGEIKIGLTFTPEPEESGE

SEQ ID NO: 2533 - protein, 144 aa, Zea mays
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDEDQPEENYGGWNQSS

SEQ ID NO: 2534 - protein, 144 aa, Pseudoroegneria spicata
MAQGTLEVLLVGAKGLENTDYLCNMDPYAVLRCTSQEQKSTVASGKGSDPEWNETFVFTVSENASELVIKLLDSDGGTEDDSVGEATIPLDAVYSEGSIPPTVYNVVKDEEYRGEIKIGLTFTPEEARDQDEPEENYGGWNQSS

SEQ ID NO: 2535 - protein, 133 aa, Secale cereale
  misc_feature (44)..(44): Xaa can be any naturally occurring amino acid
MAQGTLEVLLVGAKGLENTDYLCNMDPYAVLKCTSQEQKSTVAXGKGSDPEWNETFVFTVSENARELVIKLLDSDGGTEDDSVGEATIPLDGVYTEGSIPPTVYNVVKDEEYRGEIKIGLTFTPEEARDQDQP

SEQ ID NO: 2536 - protein, 129 aa, Picea glauca
MAQGTLEVLLVGAKGLENTDFLCDMDPYAVLRCTSDEQKSSVASGKGSEPEWNETFVFTTSEHATELIIKLLDSDAGTEDDIVGEATIPLDAVYGEGRIPPTVYNVVKDEEYRGEIKIGLTFTPEECRD

SEQ ID NO: 2537 - protein, 144 aa, Triticum aestivum
MAQGTLEVLLVGAKALENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDQDQPEENYGGWNQSS

SEQ ID NO: 2538 - protein, 144 aa, Triticum aestivum; identical to SEQ ID NO: 2533

SEQ ID NO: 2539 - protein, 144 aa, Triticum aestivum
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDQDQPEENYGGWNQSS

SEQ ID NO: 2540 - protein, 218 aa, Saccharum officinarum
  misc_feature (3)..(3): Xaa can be any naturally occurring amino acid
  misc_feature (18)..(18): Xaa can be any naturally occurring amino acid
  misc_feature (42)..(42): Xaa can be any naturally occurring amino acid
  misc_feature (128)..(128): Xaa can be any naturally occurring amino acid
MAXYRSRSPSRSYSPRRXYSRSPPRRKRYDDPRDRYRWAGAXGGGDRRGYGRPSAQSGLLIRNISLTARPEDIRVPFEQFGPIKDVYLPRNFHTRELRGFGFVKFRYPEDAAVAKQEMNHQVIGGREXSIVYAEENRKTPQEMRMRTRTSGRYMEGRYTRRSLSRSPRSRSHSYSPSPSPVRRDFRAGDAGMIIPLSTHTLHALGTTGATGQIIALQA

SEQ ID NO: 2541 - protein, 967 aa, Brachypodium distachyon
MAAAAGNVEFIRARSDKREYRRVVLPNSLECLLIRDADTDKAAACMEVGVGSFSDPEGLEGLAHFLEHMLFYASEKYPGEQDYTKYISEHGGSSNAFTSSETTNFYFDVNVDNFEEALDRFAQFFIKPLMSQDAVLREIKAVDSEHKKNLLSDGWRMYQLEKHLASKDHPYHKFSTGSWETLETKPKERGLDIRLELLKFYENYSANLMHLVVYGKESLDCIQSLVESLFINIKNTDQRSFKCPSQPLSAEHLQLLVKAIPIREGDYLKISWPVTPNIHFYKEGPCRYLSHLVGHEGEGSIFHIIKELGWAMDLVAGSGSDSNEYSFFSVGMRLTDAGHEHMEDIIGLVFKYLHLLKEDGIHEWIFNELASTNETAFHYQDKVHPISYVTGTVSGMRLFPPEEWLVGASLPSKYAPNRINMILDELSSERVRILCESKIFEGTTNCAEPWYNTSYSVENVTPQMIQQWIQKAPTEKLHLPKPNIFIPKDLSLKEVCDKVKFPTVLRKTPLSRLWYKPDMLFFTPKVNVIIDFHCPLSSHSPEAAVSTSLFVDLLVDYLNAYAYDAQIAGLFYSIYLTSTGFQVAVCGYNDKMRVLLHAIMKQIATFEVKANRFSALKETSVKDYQNFNFSQPYSQASYYLSLILEETKWPLVEKLHALSKLESDSLAKFVPHLLSKTYLECYVQGNIEPGEAESIVQETEDTIFNTPNSVFKSMSPSQYLVKRVIMLENELKCYYQIEGLNQKNENSSIVQYIQVHQDAAISNIKLQLFSLIASQPAFNQLRTVEQLGYITYLSTRSDRGVRALEVVIQSTVKDPSYLDARIDEFFKIFESKIHELSDKDFKRNVKSLIDSKLEKFKNLWEESGFYWGEIESGALKFDRIESEVALLRDLTKEEFIEFFDQYIKVDAPQRRTISVQVFSGNHSAEFKKAITEADPPKTYRITDIFGFKRSRPLHPSLKAGPGRVTMD

SEQ ID NO: 2542 - protein, 436 aa, Cenchrus ciliaris
  misc_feature (150)..(150): Xaa can be any naturally occurring amino acid
  misc_feature (433)..(433): Xaa can be any naturally occurring amino acid
MGRRKMSAAAPPSRSWSNVGGSVIPELRAKQKMELENLTLTKQPIRTLHFFMLALLQYLKRLATYILSKGSLFVLLILLVVAPAILLVVSDGLHKKHVQEFINYAKFALWWVSLGVASSIGLGSGLHTFVLYLGPHIALFTIKAVQCGRXDLKMAPYDTIQLKVGPSWLDKKCSEFGPPIYPASTDSVRIPVFDLLPQIQLEAVLWGIGTALGELPPYFISRAARLSGSESKAVKELDTATSKEDGRVASTLNRTKLWLLSHSQHLNFFSILLLASVPNPLFDLAGIMCGQFGVPFWEFFFATLIGKAIIKTHIQTLFIVSLCNNQLLYFMEKELIWIFGHIPGFSATLPSVIAKLHAAKDKYLSPPATASSSSQVEDKQWNFSFTFVWNSIVWIVLLNFFIKIITSTAQDHLKKQQDMEIERVSDSSVSDHXKAN

SEQ ID NO: 2543 - protein, 436 aa, Zea mays
MGRRKMSAAAPPSRSWSNVGGSVIPELRAKHKTDLQNLTLTKQPLRTLHFFLLAMLQYLKRLATYILSKGGFFFLLIVLLVASGILLVVSDGLHKKHVQEFLNYAKFVSWWVSLGVASSIGLGSGLHTFVLYLGPHIALFTIKAVQCGRIDLKIAPYDTIQLKVGPSWLDKKCSEFGPPVYPASAHSVRIPVFDLLPQIQLEAVLWGIGTALGELPPYFISRAARLSGSESKAVQELDAATSKEDGPVASSLNRTKRWLLSHSQHLNFFSILILASVPNPLFDLAGIMCGQFGVPFWEFLFATLIGKAIIKTHIQTLFIVSLCNNQLLYLIEKELIWIFGHVPGFSATLPSVIARLHAAKDKYLSPPAPVSPSSQMGEKQWNFSFTSVWNSIVWLVLLNFFIKIVTSTAQDYLKKQQDTEMELISDSPIQDHSKTN

SEQ ID NO: 2544 - protein, 438 aa, Oryza sativa
MGRRKVAAAAAATPPRGSSKAGGGVISEIREKHKLELENLTLTKHPFRTLRFFMLAMLQYLKRLATYILSKGALFVVLIVLVLAPGILLAVTDGLHKKHVQEFLNYARFVLWWVSLGVASSIGLGSGLHTFVLYLGPHIALFTIKAVQCGRIDLKTAPYDTIQLKQGPSWLDKKCSDFGPPVYQASAHSVRIPVFELLPQVQLEAVLWGIGTALGELPPYFISRAARLSGSEPEAVKELDAAASDEHGPIASTLNRTKRWLLSHSQHLNFITILILASVPNPLFDLAGIMCGQFGIPFWEFFFATLIGKAIIKTHIQTLFIISLCNNQLLYLMEKELIWIFGHIPGFSASLPSVIAKLHSAKDKYLSTPTSATSSSKMEDTQWNFSFTLVWNTVVWLVLVNFFIKIVTSTAQEYLKKQQDIEMELITDSSPQSQSKTN

SEQ ID NO: 2545 - protein, 436 aa, Sorghum bicolor
MGRRKMSAAAPPSRSWSNVGGSVIPELRAKHKMDLENLTLTKQPLRTLHFFLLAMLRYLKRLATYILSKGGFFFLLIVLLVASGILLAVSDGQNKKHVQEFLNYAKFVLWWASLGVASSIGLGSGLHTFVLYLGPHIALFTIKAVQCGRIDLKMAPYDTIQLKVGPSWLDKKCSEFGPPVYPASAHSVRIPVFDLLPQIQLEAVLWGIGTALGELPPYFISRAARLSGSKSKAVKELDAATSKEDGPVSSTLNRTKRWLLSHSQHLNFFSILILASVPNPLFDLAGIMCGQFGVPFWEFFFATLIGKAIIKTHIQTLFIVSLCNNQLLYLIEKELIWIFGHIPGFSATLPTVIAKLHAAKDKYLSPPAPVSPSSQMEGKQWNLSFTFVWNSIVWLVLLNFFIKIITSTAQDYLKKQQDMEMELISDSPLLDHSKTN

SEQ ID NO: 2546 - protein, 134 aa, Sorghum bicolor
MGRRKMSAAAPPSRSWSNVGGSVIPELRAKHKMDLENLTLTKQPLRTLHLFLLAMLQYLKRVAKYILSKGGLFFLLIVLVVAPGILLAISDGVHKKHVQEFLNYAKFVLWWVSLGVASSIGLGKVLVCIRLCSI

SEQ ID NO: 2547 - protein, 110 aa, Saccharum officinarum
  misc_feature (98)..(98): Xaa can be any naturally occurring amino acid
  misc_feature (106)..(106): Xaa can be any naturally occurring amino acid
MGRRKMSAAAPPSRSWSNVGGSVIPELRAKHKMDLENLTLTKQPLRTLHLFLLAVLQYLKRLAKYILSKGGLFFLLIVLVVAPGILLAISDGVHKKEXLNYAKFVXGGFH

SEQ ID NO: 2548 - protein, 430 aa, Panicum virgatum
MGRRKMSAAAPPSRSWSNVGGSVIPELRVKHKMELENLTLTKQPLRTLHFFLMALLQYLKRLATYILSKSGLFVLLLVLVVAPGIFLVVSDGLHKKHVQEFINYAKFVLWWVSLGVASSIGLGSGLHTFVLYLGPHIALFTIKAVQCGRIDLKMAPYDTIQLKAGPSWLDKKCSEFGPPVYPASAHSVRIPVFDLLPQIQLEAVLWGIGTALGELPPYFISRAARLSGSESKAVKELDAATSKEDGRVASTLNRTKRWLLSHSQHLNFFSILILASVPNPLFDLAGIMCGQFGVPFWEFFFATLIGKAIIKTHIQTLFIVSLCNNQLLYLIEKELIWIFGHIPGFSATLPSVIAKLHAAKDKYLSPPAAVSSSSQMEDKQWNFSFTFVWNSIVWFVLLNFFIKIITSTAQDYLKKQQDMEMELVSDSKTN

SEQ ID NO: 2549 - protein, 370 aa, Sorghum bicolor
MLRSTGDRVVIVGGGIAGALLAKTLQNHADVVLIDPKEYFEIPWANLRATVDPAAVERTVIPHSDYLTHAKVVTAFAVGVDDSVVLTSIGRAVAYDFLVIATGRTCNRPQKQSERLEMFQRDKERIDAAASVLIIGGGPIGVELAAEIVMKSPEKRVTVVHGAPRLLKVMGARASAKALEWLRSKNVTVLLDQTVDLASAAPDTREFTTSAGETVEADCHFVCTGRPVASRWLSGTILGEHVDEEGHLRVDDHLRVGGLRNVFAVGDITDVPEAKQGHLAQRQAMVVSRNLRLLVKQGATREEKLHRYKPSPRTSMTVTLGHRDALAELPFMTLIGHIPGAVKPRDHFITRTRRMMGIRSKPYGTMPHVM

SEQ ID NO: 2550 - protein, 402 aa, Brachypodium distachyon
MESSGGAPPAEERRLLAASLTARYSDWVLEELDELPGSFLLTDPAMSGHPIVYASRGLASLTGYRPRDVLGRNARLFQGAATDRAAVAGVRDAVRCQRAHQVAILNYRRDGAPHWVLLHVAPVFHAHDGRVLHFLAVQVPIAAAPRRRAAPCRRPPVFAACREEARVEEELPCASHAGEAFVDIDKRGLETTRWLEAGEPRVASGCDKEKALSTANSIFSALNRYSKLTGLVVCGKRCDSAGIPALSSSLNLSLGRIKQSFVLTDRHLPDMPVVYASDAFLSLTGYSREEILGCNCRFLNGPGTSLEVLEEINRNICCEQACTVHLLNYRKDGLAFPDLLHVSPIRNASGKVAFHVWVHLDESIKHDFNGLSPEVWQLGAVGAVRVAVRSLSASGSLLRPSQ

SEQ ID NO: 2551 - protein, 247 aa, Pseudoroegneria spicata
MEGEERRLAASLTARYSEWVLEELDELQGSFLLTDPAMPGHPIVYASRGLAALTGYPRREVLGRNARLFQGAATDRAAVSGVREAVRAQRAHQVAILNYRRDGSPHWVLLHLAPVFHAADGRVLHFLAVQVPIAASPRRHPGRPAAFAACREEARGEEELPCASHVGEVFVDIDKRGLEAEEPRVASGCDKEMAVTTANSIFSTLNRYSKVTGLVVCEKRCDSVGIPALSSSLNLSLELTAICLTCR

SEQ ID NO: 2552 - protein, 423 aa, Brachypodium distachyon
MGVTGRPSAAAVLLAGAVACCAALAVAAQTQQQQQRKHVRISGNAGDVLEDNPVGKLKVFVYEMPRKYNQYLLEKDNRCLYHMFAAEIFMHQFLLASAVRTMDPEEADWFYTPVYTTCDLTQQGFPLPFRAPRMMRSAVQYIAATWPYWNRTEGADHFFLAPHDFGACFHYQEERAIERGILPVLRRATLVQTFGQRNHVCMQEGSITIPPYANPQKMQAHLISPGTPRSIFAYFRGLFYDMGNDPEGGYYARGARASVWENFKDNPLFDMSTEHPSTYYEDMQRAIFCLCPLGWAPWSPRLVEAVVFGCIPVIIADDIVLPFADAIPWDQISVFVPEADVPRLDSILASVPPEDVLRKQRLLASPAMKQAVLFHQPAQPRDAFDQVLNGLARKLPHREGVFLRPGQKVIDWNAGQYDDLKPW

SEQ ID NO: 2553 - protein, 417 aa, Zea mays
MGAHATAAAAAVLLVATCVAAAAAAPLQQHEPGRISGDAVGVLDDDPVGKLKVFVYEMPRKYNRMLLDKDSRCLHHMFAAEIFMHQFLLSSAVRTLDPEEADWFYTPAYTTCDLTPQGFPLPFRAPRIMRSAIRYVATTWPFWNRTDGADHFFLTPHDFGACFHYQEERAMERGILPLLRRATLVQTFGQRNHVCLQDGSITVPPYADPGKMQAHLISPGTPRSIFVYFRGLFYDMGNDPEGGYYARGARASVWENFKDNPLFDISTEHPSTYYEDMQRAIFCLCPLGWAPWSPRLVEAVVFGCIPVIIADDIVLPFADAIPWEDISVFVAERDVPRLDSILTSIPLPDILRRQRLLARDSVKQALLFHQPARPGDAFHQVLNGLARKLPHGEGVFLQPGEKALDWDAGLQSDLKPW

SEQ ID NO: 2554 - protein, 415 aa, Sorghum bicolor
MGPCVAAVVAILLVATCVAAAPPQQQPRKPGRISGNAVGVLDDDPVGKLKVFVYEMPRKYNKMLLDKDSRCLHHMFAAEIFMHQFLLSSAVRTLDPEEADWFYTPVYTTCDLTPQGFPLPFRAPRIMRSAIRYVATTWPFWNRTDGADHFFLTPHDFGACFHYQEERAMERGILPLLRRATLVQTFGQRNHVCLQDGSITVPPYADPHKMQAHLISPGTPRSIFVYFRGLFYDMGNDPEGGYYARGARASVWENFKDNPLFDISTEHPYTYYEDMQRAIFCLCPLGWAPWSPRLVEAVVFGCIPVIIADDIVLPFADAIPWEDISVFVAERDVPRLDSILTSIPLADILRRQRLLARESVKQALLFHQPARTGDAFHQVLNGLARKLPHGDGVFLQPGEKVLDWDAGLDSDLKPW

SEQ ID NO: 2555 - protein, 405 aa, Panicum virgatum
AVILLVASCVAAAPLQQHQRARITGDAGGVLDDNPVGKLKVFVYEMPRKYNQMLLSKDSRCLHHMFAAEIFMHQFLLSSAVRTLDPEEADWFYTPVYTTCDLTPQGFPLPFRAPRIMRSAVKYVATTWPYWNRTEGADHFFLTPHDFGACFHYQEERAMERGILPLLRRATLVQTFGQRNHVCLQEGSITIPPYANPHKMQAHLINPGTPRSIFVYFRGLFYDMGNDPEGGYYARGARASVWENFKDNPLFDISTEHPSTYYEDMQRAIFCLCPLGWAPWSPRLVEAVVFGCIPVIIADDIVLPFADAIPWEQISVFVAERDVPRLDSILTSIPLQDILRKQRLLAGASVKQALLFHQPARPGDAFDQILNGLARKLPHGKGVFLQPGEKVLDWDAGLESDLKPW

SEQ ID NO: 2556 - protein, 339 aa, Leymus cinereus x Leymus triticoides
MMKTVAVAVAVLLAVAVAAEASELKAGYYDKSCRGVENVVKWHVAKAIKANRKSGAALVRLIFHDCFVRGCDASVLLDPTPENPNTEKTAPINIGLAAFDLLDDIKSAVEDRCPGIVSCADILIFAARDAASLLSNGHVHFDALAGRLDGVHSHAAEAQQDLPDSTFTISELIQNFKRKNFTIEELVILSGAHAVGVGHCSSLRARLTAPAEQILPAYRGLLAGKCAKGPDPIVPNNIRDEDAGAVAATIPGFLPKLRKVKDFLDNSYYHNNLARIVTFNSDWQLMTEKEARGHVHEYADNGTLWDEDFSDSLVKLSKLPMPHGSKGEIRKQCRFVNHY

SEQ ID NO: 2557 - protein, 340 aa, Oryza sativa
MRLAAAVVVMVVVAAAAMSVEAELSVDYYKKSCPGVENVVRYHVAKALKANRKEGAALVRLIFHDCFVRGCDASVLLDPTAENPHTEKTAPINIGLAAFELIDEIKAAVEERCPGVVSCADIVIYAARDASILLSNGHVHFDVLAGRLDGRVSRAADAQRDLPDSTFTISELIRNFRRKNFTIEELVILSGAHAVGVGHCSSLRARLTAPPEQILPGYRSLLAGKCAAGEDPIVPNNVRDEDPAAVAATIPSFLPKLRKFEFLDNSYYHNNLARIVTFNSDWQLLTEKKARGHVHEYADNGTLWDEDFSDALVKLSKLPLPPKAKGEIRRHCRRVNTHHY

SEQ ID NO: 2558 - protein, 340 aa, Triticum aestivum
MMRTVAAVAVAVLLAAAVAAEASELKVGYYDKSCRGVENVVKWHVARAIKANRKSGAALVRLIFHDCFVRGCDASVLLDPTPENPHTEKTAPINIGLAAFDLLDDIKAAVEDRCPGVVSCADILIFAARDAASLLSNGHVHFDALAGRLDGVHSHAAEAQQDLPDSTFTIAELIQNFKRKNFTIEELVILSGAHAVGVGHCSSLRARLTAPADQILPAYRGLLAGKCAKGPDPIVPNNIRDEDAGAVAAAIPGFLPKLRKVKDFLDNSYYHNNLARIVTFNSDWQLLTEKEARGHVHEYADNGTLWDEDFSDSLVKLSKLPMPHGSKGEIRKMCRFVNHH

SEQ ID NO: 2559 - protein, 415 aa, Aquilegia formosa
MMVEGPKFTGIIGNANNGNNFYDFTQGFYQKLGEGSNMSIDSMGSLQTSNGGGSISMSVDNSSVGSNDSHTHILNHPGLRPVHNNNSVGHSVLRPGRVSHALSDDALAQALMDSRFPTEGLQNFDEWTIDLRKLNMGMAFAQGAFGKLYKGTYNGEDVAIKILERPENSPEKAQLMEQQFQQEVMMLATLKHPNIVRFIGGCRKPMVWCIVTEYAKGGSVRQFLQRRQNRSVPLKLAVKQALDVARGMAYVHGLGFIHRDLKSDNLLIFGDKSIKIADFGVARIEVQTEGMTPETGTYRWMAPEMIQHRPYTQKVDVYSFGIVLWELITGMLPFQNMTAVQAAFAVVNKGVRPIIPNDCLPVLNEIMTRCWDANPEVRPPFSEVVRMLEHAEAEVMSTVRKARFRCCITQPMTVD

SEQ ID NO: 2560 - protein, 416 aa, Hordeum vulgare
MMESAKFPGIISAVSGQDGGVNFCDMAYYQKLGEGSTMSIDSLNSMQTSMHGGSIMSVDNSSVGSTDSRTGMLNHPSHRGPVAVVSYSVGNSIFRPGRVSHALSDDALAQALMDTRFPTETLKDYEEWTIDLGKLHMGLPFAQGAFGKLYRGTYNGMDVAIKLLERPEADPPQAQLLEQQFVQEVRMLAELRHPNIVKFVGACRKPIVWCIVTGYAKGGSVRNFLNRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELITGTLPFPNMTAVQAAFAVVNKGVRPAIPHDCLPALGEIMTRCWDANPDVRPPFTDVARMLERVEIEVLNNVRKARFRCCISQPMTLD

SEQ ID NO: 2561 - protein, 417 aa, Brachypodium distachyon
MMDGAKFPGIIGAVGGGHDGGVNFCDMAYYQKLGEGSTMSIDSMNSMQTSMHGGSIMSVDNSSVGSTDSRTGMLNHPGLRGPVAVASYSVGNSIFRPGRVSHALSDDALAQALMDTRFPTETLKDYEEWTIDLGKLHMGMPFAQGAFGKLYRGTYNGMDVAIKLLERPEAAPVQAQLLEQQFVQEVMMLATLRHPNIVKFIGACRKPMVWCIVTEYAKGGSVRNFLTRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELITGTLPFAKMTAVQAAFAVVNKGVRPTIPHDCLPALGEIMTRCWDANPDVRPPFTDVVRMLEHVEMEVLTSVRRARFRCCISQPMTLD

SEQ ID NO: 2562 - protein, 414 aa, Zea mays
MAEGPNFAGMIGGHDNGGDFCDMAYYRKLGEGSNMSVDNLNSMQTSTHGGSIAMSVDNSSVGSCDSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFIGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPTLAEIMTRCWDPNPDVRPPFTEVVRMLEHAEMEILSTVRKARFRCCMSQPMTTD

SEQ ID NO: 2563 - protein, 423 aa, Zea mays
MAQGINFPDFIGAVGGHDGGVDFGGNFCDMAFYQKLGEGTNMSVDSLNSMQTSMHGGSIAMSVDNNSSVGSNSDSRTGMLGHPGLKGPAIVGSYSVGHSIFRPGRVSHALSEDALAHALMDNKFPTETLKDYEEWTIDLGKLHLGMPFAQGAFGKLYRGTYNGMDVAIKLLERPEADPEKAQLLEQQFVQEVMMLATLRHPNIVKFIGACRKPLVWCIVTEYAKGGSLKNFLSKRQNRSVPLKLAVKQALDVARGMAYVHGLGFIHRDLKSDNLLISGDKSIKIADFGVARIEVKTEGMTPETGTYRWMAPEMIQHRPYNQKVDVYSFAIVLWELVTGNVPFANMSAVQAAFAVVNKGVRPAIPHDCLPALAEIMTMCWDTNPEVRPPFAEIVRMLEQVEVEVLTTVRKARFRCCIAQPMTLD

SEQ ID NO: 2564 - protein, 414 aa, Zea mays
MVEGPNFAGLIGGHDNGGNFCDMAYYRKLGEGSNMSIDSLNSMQTSTHGGSIAMSVDNSSVGSCSSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFIGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPTLGEIMTRCWDPNPDVRPPFTEVVRMLEHAEVEILSTVRKARFRCCISQPMTTD

SEQ ID NO: 2565 - protein, 417 aa, Oryza sativa
MAEGAKFHGIVGAVGAHDVGGNFCDMGYYQKLGEGSNMSIDSLNSMQTSIYGGSVAMSVDNSSVASSDSRTGMLKHPGLRGPVIVSSYSVGNSIFRPGRVSHALSDDALAQALMDSRFPTETLKDYEEWTIDLGKLHIGMPFAQGAFGKLYRGTYNGGDVAIKLLERPEADPEKAQLLEQQFVQEVMMLATLRHSNIVKFVGACRKPMVWCIVTEYAKGGSVRNFLNRRQNRSVPLKLAVKQALDVARGMAYVHGLGFIHRDLKSDNLLISGDKSIKIADFGVARIEVKTEGMTPETGTYRWMAPEVIQHRPYDQKVDVYSFGIVLWELVTGNLPFANMTAVQAAFAVVNKGVRPAIPHDCLPALAEIMTRCWDANPDARPPFTEVVRMLEQVEMEVVNTVRRARFRCCISQPMTLD

SEQ ID NO: 2566 - protein, 414 aa, Sorghum bicolor
MVEGPNFAGMIGGHDNGGNFCDMAYYRKLGEGSTMSIDSLNSMQTSTHGGSIAMSVDNSSVGSCDSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFIGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPTLAEIMTRCWDPNPDVRPPFTDVVRMLEHAEMEILSTVRKARFRCCISQPMTTD

SEQ ID NO: 2567 - protein, 417 aa, Sorghum bicolor
MAQGANFPNFIGAVGGHDDGVNFGGNFCDMAFYQKLGEGSNMSVDSINSMQTSMHGGSIASSICSNSDSRTGMLGHPGLKGPVIVGSYSVGHSIFRPGRVSHALSEDALAHALMDNKFPTETLKDYEEWTIDLGNLHMGMAFAQGAFGKLYRGTYNGMDVAIKLLERPEADPEKAQLLEQQFVQEVMMLATLRHPNIVKFIGACRKPLVWCIVTEYAKGGSLKNFLSKRQNRSVPLKLAVKQALDVARGMAYVHGLGFIHRDLKSDNLLISGDKSIKIADFGVARIEVKTEGMTPETGTYRWMAPEMIQHRPYNQKVDVYSFAIVLWELVTGNLPFANMTAVQAAFAVVNKGVRPAIPHDCLPALGEIMTRCWDADPEVRPPFTEIVRMLEQVEMEVLTTVRKARFRCCVAQPMTLD

SEQ ID NO: 2568 - protein, 414 aa, Saccharum officinarum
MVEGPNFAGMIGGHDNGGNFCDMAYYRKLGEGSNMSIDSLNSMQTSTHGGSIAMSVDNSSVGSCDSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFVGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPTLAEIMTRCWDPNPDVRPPFTDVVRMLEHAEMEILSTVRKARFRCCISQPMTTD

SEQ ID NO: 2569 - protein, 422 aa, Panicum virgatum
MAQGANFPGFIGAAGGHDGGVNFGGGFCDMAFYQKLGEGSNMSMDSLNSMQTSMHGGSIAMSVDNSSVGSNSDSRTGMLGHPGLKGPVVVGSYSVGNSIFRPGRVSHALSEDALAQALMDNRFPTETLQNYEEWTIDLGKLHLGMPFAQGAFGKLYRGTYNGMDVAIKLLERPEADPEKAQLLEQQFVQEVMMLATLRHPNIVKFIGACRKPLVWCIVTEYAKGGSLKNFLSRRQNRSVPLKLAVKQALDVAHGMAYVHGLGFIHRDLKSDNLLISGDKSIKIADFGVARIEVKTEGMTPETGTYRWMAPEMIQHRPYNQKVDVYSFGIVLWELVTGNVPFANMTAVQAAFAVVNKGVRPTIPHDCLPALGEIMTRCWDSNPEVRPPFTDIVRMLEQVEMEVLRTVRRARFRCCIAQPMALD

SEQ ID NO: 2570 - protein, 115 aa, Panicum virgatum
MAPEMIQHRPYDQKVDVYSFGIVLWELITGMLPFANMTAVQAAFAVVNKGVRPAIPQDCLPTLGEIMTRCWDPNPDVRPPFTEVVRMLEHAEMEILSTVRKARFRCCISQPMTTD

SEQ ID NO: 2571 - protein, 416 aa, Triticum aestivum
MMEAGKFPGIIGAVSGQDGGVNFCDMAYYQKLGEGSTMSIDSLNSMQTSMHGGSIMSVDNSSVGSTDSRTGMLNHPSHRGPVAVVSYSVGNSIFRPGRVSHALSDDALAQALMDTRFPTETLKDYEEWTIDLGKLHMGLPFAQGAFGKLYRGTYNGMDVAIKLLERPEADPAQAQLLEQQFVQEVMMLAELRHPNIVKFVGACRKPIVWCIVTGYAKGGSVRNFLNRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELITGTLPFPNMTAVQAAFAVVNKGVRPAIPHDCLPALGEIMTRCWDANPDVRPPFTDVVRMLERVEMEVLNNVRKARFRCCISQPMTLD

SEQ ID NO: 2572 - protein, 419 aa, Oryza sativa
MNTKKIKLHDCHFGSPLCDPSPAPHLLSSAAAAGLSFHPGLVSSAAQHQQHGAGGWLHEEYYAPRSSPPSSLLAQTCVGSNATAFYAAENLPQFDFPALGTAAAAAAKAPFRSSESELYRPVDPLLLRADHSVRTYYVRPQKRDSGERTPLPPPSQQQHQDRIHGLFAGAPTTRLLSGEPKIHSFPPQVAAKPILPAMDAPSLQNQMENQLTRNCIGAATPVTPTGNLAGSGAPSKTRIRWTQDLHERFVDCVNQLGGADKATPKGILKLMNSDGLTIYHIKSHLQKYRIAKYMPASSEGKQLEKRATGNDMQNLDPKTGMQITEALRVQLDVQRRLHEQLEIQRNLQLRIEEQGKRLQKMFEDQLKASRSVMEPQELDDVVAFAAGDGDDDAFDDVDVQLLAVAGSGYDDAGFQSKIS

SEQ ID NO: 2573 - protein, 154 aa, Amborella trichopoda
MAPKAAATKKADPKAQALKAAKAVKSGASTLKKKTKKIRTSVTFHRPKTLKKERNPKYPRISAPPRNKLDHYQILKFPLTTESAMKKIEDNNTLVFIVDIRADKKKIKAAVKKMYDIQAKKVNTLIRPDGKKKAYVRLTPDHDALDVANKIGII

SEQ ID NO: 2574 - protein, 153 aa, Antirrhinum majus
MAPKADQAKKADPKAQALKTAKAVKTGTFKKKAAKKIRTKVTFHRPRTLKKDRSPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2575 - protein, 153 aa, Antirrhinum majus
  misc_feature (8)..(8): Xaa can be any naturally occurring amino acid
MAPKADQXKKADPKAQALKTAKAVKTGTFKKKAAKKIRTKVTFHRPRTLKKDRSPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2576 - protein, 71 aa, Antirrhinum majus
MAPKVDKKADPKAQALKTAKAVKTGTFKKKAAKKIRTKVTFHRPRTLKKDRSPKYPRISAPPRNKLDITRF

SEQ ID NO: 2577 - protein, 153 aa, Malus domestica
MAPRKADVSKKADPKSQAVKAARALKSGPTVKKVKKIRTSVTFHRPRTLKKERNPKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2578 - protein, 153 aa, Malus domestica
MAPAKVDSKKKDPKAQALKTAKAVKSGPAFKKKAKKIRTSVTFHRPRTLKKERNPKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2579 - protein, 154 aa, Malus domestica
MAPAKVDSTKKSDPKAKALKTAKAVKSGPAFKKKAKKIRTSVTFHRPRTLKKERNPKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2580 - protein, 156 aa, Aquilegia formosa
MAPPSKVATTKKADPKAQALKAAKAVKSGASTLKKKVKKIRTSVTFHRPKTLTKERNPKYPRVSAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2581 - protein, 154 aa, arabidopsis lyrata
MSPAKVDVTKKTDPKAKALKAAKAVKSGQILKKPAKKIRTKVTFHRPKTLTLQRNPKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2582 - protein, 154 aa, arabidopsis lyrata
MSPAKVDTTKKVDPKAKALKAAKAVKSGQTFKKKDKKIRTKVTFHRPKTLTKPRDGKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2583 - protein, 154 aa, arabidopsis lyrata; identical to SEQ ID NO: 2582

SEQ ID NO: 2584 - protein, 154 aa, Arabidopsis thaliana [sequence omitted]

SEQ ID NO: 2585 - protein, 153 aa, Artemisia annua
MAPKADATKKGDAKSQALKTAKAVKTGTTFKKKAKKIRTKVTFHRPKTLKTDRNPKYPRISAPPRNKLDHYQILKYPLTTESAMKKIEDNNTLVFIVDLRADKKKIKAAVKKMYDIQTKKVNTLIRPDGTKKAYVKLTPDFDALDVANKIGII

SEQ ID NO: 2586 - protein, 156 aa, Persea americana
MAPPAKAASAKKNDPKAQALKAAKAVKSGASTLKKKAKKIRTSVTFHRPKTLKKERNPKYPRISAPPRNKLDQYRILKYPLTTESAMKKIEDNNTLVFIVDIKADKKMIKAAVKKMYDIQTKKVNTLIRPDGTKKAYVRLTPDYDALDVANKIGII

SEQ ID NO: 2587 - protein, 156 aa, Persea americana
MAPPTKAASTKKSDPKAQALKAAKAVKSGASTLKKKAKKIRTSVTFHRPKTLKKERNPKYPRISAPPRNKLDQYRILKYPLTTESAMKKIEDNNTLVFIVDIKADKKMIKAAVKKMYDIQTKKVNTLIRPDGTKKAYVRLTPDYDALDVANKIGII

SEQ ID NO: 2588 - protein, 154 aa, Brassica juncea
MAPAKVDVTKKADPKAKALKAAKAVKSGQVIKKKAKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2589 - protein, 154 aa, Brassica juncea
MSPAKVDTTKKADPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2590 - protein, 154 aa, Brassica juncea; identical to SEQ ID NO: 2589

SEQ ID NO: 2591 - protein, 154 aa, b_nigra; identical to SEQ ID NO: 2589

SEQ ID NO: 2592 - protein, 154 aa, Brassica oleracea; identical to SEQ ID NO: 2589

SEQ ID NO: 2593 - protein, 154 aa, Brassica oleracea
MAPAKVDVTKKADPKAKALKAAKAVKSGQIIKKKAKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2594 - protein, 154 aa, Brassica oleracea; identical to SEQ ID NO: 2588

SEQ ID NO: 2595 - protein, 154 aa, Brassica oleracea; identical to SEQ ID NO: 2589

SEQ ID NO: 2596 - protein, 154 aa, Brassica oleracea; identical to SEQ ID NO: 2589

SEQ ID NO: 2597 - protein, 154 aa, Brassica oleracea
MAPPTKDGKKVDPKAKALKAAKAVKAGASTLKKKDKKIRTKVTFHRPKTLKTSRNPKYPRISATPRNKLDHYQILKYPLTTESAMKKIEDNNTLVFIVDLRADKKKIKAAVKKMYDIQAKKVNTLIRPDGTKKAYVRLTPDHDALDVANKIGII

SEQ ID NO: 2598 - protein, 372 aa, Brassica rapa
DRPRLIHLCSGSMSTVYRKLAICGGEGGSEWDDDVYEGVRKVYVGQDLKRITYIKFDYVKVDGQVVTREYGTKDQNPKEFIVAQHPDEQIIAVEGSYNKVGLLGTDVITSLVFKTSKGRKSPTFGPNLLGLVNGTKFEFEDPGKKIVGFHGRAGDALDAIGVYFVINSLPPSLSPIYKLDAQGGTEGRVWNDGSFDAVKRLRIGQDNVRITYLEFEYAKGGKSEQLHHGVKGGTPSEFVLDFPDEYIKSVEATYDKPNLFQNTVITSLTIKTSKGRTSSFGYTKGKKFVLEQKDCPLVGFHGKVGDAIDALGAYFAPLVPAKKLPSVGGNGGVAWDDGVYDGVRKIYVGQGNDGVSFVKFEYTKGTEFGIWR

SEQ ID NO: 2599 - protein, 154 aa, Brassica rapa
MSPAKVDTTKKADPKAKALKAAKAVKSGQAFKKKDKRIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2600 - protein, 154 aa, Brassica rapa
MSPAKVDTTKKVDPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2601 - protein, 154 aa, Brassica rapa; identical to SEQ ID NO: 2589

SEQ ID NO: 2602 - protein, 154 aa, Brassica rapa
  misc_feature (12)..(12): Xaa can be any naturally occurring amino acid
MSPAKVDTTKKXDPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2603 - protein, 154 aa, Brassica rapa; identical to SEQ ID NO: 2588

SEQ ID NO: 2604 - protein, 154 aa, Brassica rapa; identical to SEQ ID NO: 2589

SEQ ID NO: 2605 - protein, 154 aa, Brassica rapa; identical to SEQ ID NO: 2589

SEQ ID NO: 2606 - protein, 154 aa, Musa acuminata
MAPPAKATSKKADDKTQALKVAKAVKSGSTLKKKAKKIRTSVTFHRPRTLTKERNPKYPRISAPPRNKLDQYQILKYPLTTESAMKKIEDNNTLVFIVDIRADKKKIKAAVKKMYDIQSKKVNTLIRPDGTKKAYVRLTPDYDALDVANKIGII

SEQ ID NO: 2607 - protein, 154 aa, Musa acuminata
MAPPAKATSKKADDKTQALKVAKAVKSGSTLKKKAKKIRTSVTFHRPKTLTRDRNPKYPRISAPPRNKLDQYQILKYPLTTESAMKKIEDNNTLVFIVDIRADKKKIKAAVKKMYDIQAKKVNTLIRPDGTKKAYVRLTPDYDALDVANKIGII

SEQ ID NO: 2608 - protein, 154 aa, Musa acuminata
MAPPAKATSKKADDKAQALKAAKAVKSGSATLKKAKKIRTSVTFHRPKTLSKARNPKYPRISAPPRNKLDHYQILMYPLTTESAMKKIEDNNTLVFIVDIRADKKKIKGAVKKMYDIQAKKVNTLIRPDGTKKAYVRLTPDYDALDVANKIGII

SEQ ID NO: 2609 - protein, 154 aa, Musa acuminata; identical to SEQ ID NO: 2607

SEQ ID NO: 2610 - protein, 154 aa, Musa acuminata; identical to SEQ ID NO: 2606

SEQ ID NO: 2611 - protein, 155 aa, Musa acuminata
MAPPAKATSKKADDKAQALKVAKAVKSGSATLKKKAKKIRTSVTFHRPKTLSKERNPKYPRISAPPRNKLDHYQILMYPLTTESAMKKIEDNNTLVFIVDIRADKKKIKGAVKKMYDIQAKKVNTLIRPDGTKKAYVRLTPDYDALDVANKIGII

SEQ ID NO: 2612 - protein, 153 aa, Ocimum basilicum
ARRIVDTSKKTDAKAHALKAAKAVKSASTFKKKAKKIRTKVTFYRPKTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2613 - protein, 153 aa, Phaseolus coccineus
MAPKADSSKKADPKAQALKTAKAVKSGATFKKKAKKDRNSVTFHRPKTLKKDRSPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2614 - protein, 154 aa, Phaseolus coccineus
MAPAKVDSSKKGDPKAQALKTAKAVKSGPTFKKKGKKTRNSVTFHRPKTLKKDRSPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2615 - protein, 154 aa, Beta vulgaris
MAPPAKDGKKADPKAQALKAAKAVKSGSSTLKKKAKKIRTKVTFHRPKTLKTDRKPKYPRISATPRNKLDHYQILKYPLTTESAMKKIEDNNTLVFIVDIRADKKKIKDSVKKMYDIQAKKVNTLIRPDGTKKAYVRLTPDYDALDVANKIGII

SEQ ID NO: 2616 - protein, 154 aa, Beta vulgaris
MAPPAKDGKKADPKAQALKAAKAVKSGSSTLKKKAKKIRTKVTFHRPKTLKKDRNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2617 - protein, 152 aa, Brachypodium distachyon
MAPKVAVAKKGDAKAQAAKVAKAVKSGSIKKKTKKIRTSVTFHRPRTLKKARDPKYPRISTPGRNKLDQYQILKYPLTTESAMKKIEDNNTLVFIVDLKADKKKIKAAVKKMYDIQAKKVNTLIRPDGKKKAYVKLTADYDALDVANKIGII

SEQ ID NO: 2618 - protein, 152 aa, Brachypodium distachyon
MAPKVAVAKKGDAKAQAAKVAKAVKSGSIKKKVKKIRTSVTFHRPRTLKKARDPKYPRISTPGRNKLDQYQILKYPLTTESAMKKIEDNNTLVFIVDLKADKKKIKAAVKKMYDIQAKKVNTLIRPDGKKKAYVKLTADYDALDVANKIGII

SEQ ID NO: 2619 - protein, 151 aa, Theobroma cacao
MAPKVEKKADPKAQALKAAKAVKSGATFKKKAKKIRTKVTFHRPKTLKKDRNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGVI

SEQ ID NO: 2620 - protein, 154 aa, Theobroma cacao
MAPAKVDSKKKTDPKAQAVKAAKAVKSGTTFKKKAKKIRTKVTFHRPKTLKKERNPKYPRISAPPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2621 - protein, 154 aa, Brassica napus; identical to SEQ ID NO: 2588

SEQ ID NO: 2622 - protein, 154 aa, Brassica napus; identical to SEQ ID NO: 2600

SEQ ID NO: 2623 - protein, 154 aa, Brassica napus; identical to SEQ ID NO: 2589

SEQ ID NO: 2624 - protein, 154 aa, Brassica napus; identical to SEQ ID NO: 2589

SEQ ID NO: 2625 - protein, 154 aa, Brassica napus
MSPAKVDTTKKTDPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2626 - protein, 154 aa, Brassica napus; identical to SEQ ID NO: 2589

SEQ ID NO: 2627 - protein, 154 aa, Brassica napus; identical to SEQ ID NO: 2589

SEQ ID NO: 2628 - protein, 154 aa, Brassica napus
MAPAKVDVTKKPDPKAKALKAAKAVKSGQIIKKKAKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2629 - protein, 154 aa, Brassica napus; identical to SEQ ID NO: 2588

SEQ ID NO: 2630 - protein, 154 aa, Brassica napus; identical to SEQ ID NO: 2589

SEQ ID NO: 2631 - protein, 154 aa, Brassica napus
MAPAKVDVTKKADSKAKALKAAKAVKSGQIIKKKAKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2632 - protein, 154 aa, Brassica napus; identical to SEQ ID NO: 2593

SEQ ID NO: 2633 - protein, 154 aa, Manihot esculenta
MAPAKADATKKTDPKAQAVKAAKAVKSGPTFKKKATKIRTKVTFHRPKTLKKERNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2634 - protein, 154 aa, Manihot esculenta
MAPAKADSSKKPDAKAQAVKAAKAVKSGPTFKKKASKIRTKVTFHRPKTLKKERNPKYPRISAPPRNKLDQYQILKFPLTTESAMKKIEDNNTLVFIVDIRADKKKIKDAVKKMYDIQAKKVNTLIRPDGTKKAYVRLTPDFDALDVANKIGII

SEQ ID NO: 2635 - protein, 154 aa, Manihot esculenta
MAPAKADSSKKPDPKAQAIKAAKAVKSGPTFKKKANKIRTKVTFHRPKTLKKERNPKYPRISAPPRNKLDHYQILKFPLTTESAMKKIEDNNTLVFIVDIRADKKKIKDAVKKMYDIQAKKVNTLVRPDGTKKAYVRLTPDFDALDVANKIGII

SEQ ID NO: 2636 - protein, 152 aa, Ricinus communis
MAPPKDSKKPDAKAQAVKAAKAVKSGPIFKKKSLKIRTKVTFHRPKTLKKDRSPKYPRISAPPRNKLDQYQILKYPLTTESAMKKIEDNNTLVFIVDLRADKKKIKDAVKKMYDIQAKKVNTLIRPDGTKKAYVRLTPDYDALDVANKIGII

SEQ ID NO: 2637 - protein, 152 aa, Ricinus communis
MAPKGDAAKKTDAKSQAVKAAKAVKSGTTFKKAKKIRTKVTFHRPKTLKKDRNPKYPRISATPRNKLDQYQILKYPLTTESAMKKIEDNNTLVFIVDLRADKKKIKDAVKKMYDIQTKKVNTLIRPDGTKKAYVRLTPDYDALDVANKIGII

SEQ ID NO: 2638 - protein, 155 aa, Catharanthus roseus
MAPPKAVPSKKSDPKAQAVKAAKAVKSGSTAFKKKPTKMRTKVTFHRPKTLKKDRNPKYPRISAPPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2639 - protein, 155 aa, Catharanthus roseus; identical to SEQ ID NO: 2638

SEQ ID NO: 2640 - protein, 152 aa, Cenchrus ciliaris
MAPKAAPAKKADAKTQALKVAKAVKSGTIKKKTKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2641 - protein, 153 aa, Centaurea maculosa
MAPPKGDVKKGDAKAQALKAAKAVKTGSTFKKKAKKIRTKVTFFRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2642 - protein, 153 aa, Centaurea maculosa
MAPKADSTKKGDAKAQALKTAKAVKTGSTFKKKAKKIRTKVTFFRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2643 - protein, 154 aa, Centaurea maculosa
  misc_feature (68)..(68): Xaa can be any naturally occurring amino acid
MAPAKADATKKGDAKAKALKTAKAVKTGSTFKKKAKKIRTKVTFFRPRTLKTDRNPKYPRISAPPRNXLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2644 - protein, 154 aa, Castanea mollissima
MAPAKADSTKKSDPKAQALKAAKAVKSGATFKKKTKKIRTSVTFHRPRTLKKARNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGII

SEQ ID NO: 2645 - protein, 154 aa, Castanea mollissima
MAPAKVDSSKKADPKAQALKAAKAVKSGATFKKKTKKIRTSVTFHRPRTLKKARNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGII

SEQ ID NO: 2646 - protein, 153 aa, Cicer arietinum
MAPKADVSKKTDPKAQALKTAKAVKSGPSFKKKAKKIRTSVTFHRPKTQTKDRNPKYPRISATPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2647 - protein, 153 aa, Cicer arietinum
MAPKGDVSKKTDPKAQALKAAKAVKSGTAIKKKAKKIRTSVTFHRPKTLTKERNPKYPRISATPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2648 - protein, 153 aa, Cichorium intybus
MAPKADATKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2649 - protein, 154 aa, Cichorium intybus
MAPAKADVTKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2650 - protein, 154 aa, Cichorium intybus
MAPAKADITKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2651 - protein, 153 aa, Citrus sinensis
MAPKVDSSKKGDPKAQATKVAKAVKSGPTFKKKAKKMRTSVTFHRPKTLKKDRNPKYPRISAPPRNKLDHYQILKYPLTTESAMKKIEDNNTLVFIVDIRADKRKIKDAVKKMYEIQTKKVNTLIRPDGTKKAYVRLTPDYDALDVANKIGII

SEQ ID NO: 2652 - protein, 152 aa, Citrus sinensis
MAPPKGETKKADPKVQALKTAKAVKSGRTFKKAKKIRTSVTFHRPKTLKKDRNPKYPRISAPPRNKLDHYQILKYPLTTESAMKKIEDNNTLVFIVDIRADKKKIKDAVKKMYDIQAKKVNTLIRPDGTKKAYVRLTPDSDALDVANKIGII

SEQ ID NO: 2653 - protein, 153 aa, Coffea canephora
MAPKADTTKKVDTKAQAAKVAKFVKSGTTFKKKAKKIRTKVTFHRPKTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2654 - protein, 151 aa, Gossypium hirsutum
MAPKVEKKADAKAQALKAAKAVKSGATFKKKAKKIRTKVTFHRPRTLKKDRNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGII

SEQ ID NO: 2655 - protein, 151 aa, Gossypium hirsutum
MAPKVEKKGDPKAQALKAAKAVKSGVTFKKKAKKIRTKVTFHRPKTLKKDRNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGII

SEQ ID NO: 2656 - protein, 151 aa, Gossypium hirsutum
MAPKVEKKSDPKAQALKAAKAVKSGATFKKKAKKIRTKVTFHRPRTLKKDRTPKYPRISAPPRNKLDHYQILKFPLTTESAMKKIEDNNTLVFIVDIRADKKKIKDAVKKMYDIQAKKVNTLIRPDGTKKAYVRLTPEYDALDVANKIGII

SEQ ID NO: 2657 - protein, 151 aa, Gossypium hirsutum
MAPKVEKKADPKAQALKAAKAVKSGATFKKAAKKIRTKVTFHRPKTLKKDRNPKYPRISAPPRNKLDHYQILKFPLTTESAMKKIEDNNTLVFIVDIRADKKKIKDAVKKMYDIQAKKVNTLIRPDGTKKAYVRLTPDYDALDVANKIGII

SEQ ID NO: 2658 - protein, 154 aa, Gossypium hirsutum
MSPAKVDSKKKADPKAQAVKAAKAVKSGVAFKKKSKKIRTKVTFHRPRTLKKDRNPKYPRISAPPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2659 - protein, 155 aa, Vigna unguiculata
MAPTKVVNAKKADPKAQALKTAKAVKSGGQVFKKKTKKIRTSVTFHRPKTLKKDRSPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2660 - protein, 154 aa, Vigna unguiculata
MAPAKVDSSKKGDPKAQALKTAKAVKSGPTFKKKAKKIRTSVTFHRPKTLKKDRNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2661 - protein, 153 aa, Vigna unguiculata
MAPKADSSKKADAKAQALKTAKAVKSGATFKKKAKKIRTSVTFHRPKTLKKDRNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2662 - protein, 154 aa, Cryptomeria japonica
MAPPKGAAKKADPKGQAQKAAKAVKAGAITLKKRTKKIRTSVTFHRPKTLKTPRNPKYPRLSAPHRNKLDQYEVLKYPLTTESAMKKIEDNNTLVFIVDVRADKKKIKDAVKKMYDIQTKKVNTLIRPDGLKKAYVRLTPDYDALDVANKIGII

SEQ ID NO: 2663 - protein, 154 aa, Cryptomeria japonica
MAPPKAAAKKADPKGQAHKAAKAVKAGAITLKKRTKKIRTSVTFHRPKTLKTPRNPKYPRLSAPRRNKLDQYEVLKYPLTTESAMKKIEDNNTLVFIVDVRADKKKIKDAVKKMYDIQTKKVNTLIRPDGLKKAYVRLTPDYDALDVANKIGII

SEQ ID NO: 2664 - protein, 146 aa, cucumber
MTKKADPKAQALKTAKAVKSGPTFKKAKKIRTSVTFHRPKTLKKDRNPKYPRISVTPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2665 - protein, 153 aa, cucumber
MAPKADSSKKADPKAQALKTAKAVKSGPTFKKKAKKIRTSVTFHRPKTLKKDRNPKYPRISVTPRNKLDQYQILKYPLTTESAMKKIEDNNTLVFIVDIRANKKNIKDAVKKMYDIQTKKVNTLIRPDGTKKAYVRLTPDYDALDVANKIGII

SEQ ID NO: 2666 - protein, 153 aa, cucumber
MAPKADSTKKTDPKAQALKTAKAVKSGPTFKKKAKKIRTSVTFHRPKTLKKDRNPKYPRISVTPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2667 - protein, 154 aa, Cynara scolymus
MAPAKGDVTKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2668 - protein, 154 aa, Taraxacum officinale
MAPAKADVAKKGDAKAQAMKAAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2669 - protein, 154 aa, Taraxacum officinale
MAPAKADTTKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2670 - protein, 154 aa, Eucalyptus gunnii
MAPPKGDNVKKSDPKAQALKAAKAVKSGPTFKKKAKKIRTSVTFHRPRTLKKDRNPKYPRISAPPRNKLDHYQILKYPLTTESAMKKIEDNNTLVFIVDIRADKKKIKDAVKKMYDIQAKKVNTLIRPDGTKKAYVRLTPDFDALDVANKIGII

SEQ ID NO: 2671 - protein, 155 aa, Eucalyptus gunnii
  misc_feature (106)..(106): Xaa can be any naturally occurring amino acid
MSPIKADPTKKADPKAQALKAAKAVKSGAATFKKKAKKIRTSVTFHRPRTLKKERNPKYPRISAPPRNKLDHYQILKYPLTTESAMKKIEDNNTLVFIVDIRADKXKIKDAVKKMYEIQTKKVNTLIRPDGTKKAYVRLTPDYDALDVANKIGII

SEQ ID NO: 2672 - protein, 128 aa, Festuca arundinacea
  misc_feature (85)..(85): Xaa can be any naturally occurring amino acid
MAPKAAVAKKGDAKAQAVKVAKAVKSGSIKKTAKKIRTSVTFHRPRTLKKARDPKYPRVSTPGRNKLDQYQILKYPLTTESAMKXIEDNNTLVFIVDLKADKKKIKAAVKKMYDIQAKKVNTLIRPDG

SEQ ID NO: 2673 - protein, 153 aa, Linum usitatissimum
MAPPKDNKPKPDAKAQAVKAAKAVKSGPTFKKNVKKIRTKVTFHRPRTLKLERNPKYPRISAPPRNKLDHYQILKFPLTTESAMKKIEDNNTLVFIVDILADKKKIKDAVKKMYDIQAKKVNTLIRPDGTKKAYVRLTPDYDALDVANKIGII

SEQ ID NO: 2674 - protein, 153 aa, Gerbera hybrid cultivar
MAPKADVTKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2675 - protein, 70 aa, Gerbera hybrid cultivar
MKKIEDNNTLVFIVDIRADKKKIKDAVKKMYDIQTKKVNTLIRPDGTKKAYVRLTPDYDALDVANKIGII

SEQ ID NO: 2676 - protein, 146 aa, Gerbera hybrid cultivar
SKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2677 - protein, 151 aa, Zingiber officinale
MAPKATSKKSDEKTQAEKAAKAVKSGTTIKKAKKIRTSVTFHQPKTLKKPRNPKYPRISAPPRNKLDHYQILKYPLTTESAMKKIEDNNTLVFIVDLRADKKKIKAAVKKMYDIQAKKVNTLIRPDGTKKAYVRLTPDYDALDVANKIGII

SEQ ID NO: 2678 - protein, 145 aa, Zingiber officinale
KKPDDKAQAEKVAKAVKTGSTLKKKTKKIRTSVTFHRPKTLQKPRNPKYPRISAPPRNKLDHYQILKYPLTTESAMKKIEDNNTLVFIVDLRADKKKIKAAVKKMYDIQAKKVNTLIRPDGTKKAYVRLTPDYDALDVANKIGII

SEQ ID NO: 2679 - protein, 155 aa, Vitis vinifera
MAPAKVDPTKKADPKTHAAKTAKALKSGTATFKKKAKKIRTSVTFHRPRTLKKDRNPKYPRISAPSRNKLDQYQVLKYPLTTESAMKKIEDNNTLVFIVDIRADKKKIKDAVKKMYEIQTKKVNTLIRPDGTKKAYVRLTPDYDALDVANKIGII

SEQ ID NO: 2680 - protein, 155 aa, Vitis vinifera
MAPSKVESTKKTDPKAQAQKAAKTVKSGGGTFKKKAKKIRRSVTFHRPRTLKKERNPKYPRISAPPRNKLDQYQILKYPLTTESAMKKIEDNNTLVFIVDIRADKKKIKDAMKKMYDIQTKKVNTLIRPDGTKKAYVRLTPDYDALDVANKIGII

SEQ ID NO: 2681 - protein, 155 aa, Vitis vinifera
MAPAKADSSKKADPKAQAAKAAKAVKSGASTFKKKAKKIRTSVTFHRPKTLKKERNPKYPRISAPSRNKLDQYQILKYPLTTESAMKKIEDNNTLVFIVDIRANKKKIKDAVKKMYDIQTKKVNTLIRPDGTKKAYVRLTPDYDALDVANKIGII

SEQ ID NO: 2682 - protein, 154 aa, Mesembryanthemum crystallinum
MAPPAKDGKKADPKAQALKAAKAVKSGASTIKKKAKKIRTKVTFHRPRTLKKERNPKYPRISATPRNKLDHYQILKFPLTTESAMKKIEDNNTLVFIVDIRADKKKIKAAVKKMYDIQAKKVNTLIRPDGTKKAYVRLTLDYDALDVANKIGII

SEQ ID NO: 2683 - protein, 151 aa, Ipomoea nil
MAPKAAEKKPDPKAQAAKAAKAVKGTTFKKKTKKIRTKVTFHRPRTLKKDRNPKYPRISAPPRNKLDHYQILKYPLTTESAMKKIEDNNTLVFIVDIRADKKKIKDAVKKMYEIQTKKVNTLIRPDGTKKAYVRLTPDFDALDVANKIGII

SEQ ID NO: 2684 - protein, 152 aa, Ipomoea nil
MAPKGDSTKKADPKAQAAKVAKAVKGTTFKKKAKKIRTKVTFHRPRTLKKERNPKYPRISAPPRNKLDHYQILKYPLTTESAMKKIEDNNTLVFIVDIRADKKKIKDAVKKMYDIQTKKVNTLIRPDGTKKAYVRLTPDFDALDVANKIGII

SEQ ID NO: 2685 - protein, 152 aa, Jatropha curcas
MAPKDSSKKPDAKAQAVKAAKAVKSGPTFKKKAKKIRTKVTFHRPKTLKKERNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2686 - protein, 154 aa, Actinidia deliciosa
MAPKADSTKKSDPKGQALKAAKAVKSGSVAFKKKVKKIRTSVTFHRPRTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2687 - protein, 152 aa, Actinidia deliciosa
MAPKADGTKKADPKAQALKAAKAVKSTTFKKKAKKIRTSVTFHRPRTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2688 - protein, 155 aa, Actinidia deliciosa
MAPAKADPTKKSDPKAQAVKAAKAVKSGSLTFKKKAKKIRTSVTFHRPRTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2689 - protein, 152 aa, Actinidia deliciosa; identical to SEQ ID NO: 2687

SEQ ID NO: 2690 - protein, 152 aa, Actinidia deliciosa
MAPKAEGTKKADPKAQALKAAKAVKSTTFKKKAKKIRTSVTFHRPRTLKKDRNPKYPRISAPPRNKLDHYQILKYQLTTESAMKKIEDNNTLVFIVDIRADKKKIKDAVKKMYDIQTKKVNTLIRPDGTKKAYVRLTPDYDALDVANKIGII

SEQ ID NO: 2691 - protein, 154 aa, Lactuca sativa
MSPAKADATKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2692 - protein, 153 aa, Lactuca sativa
MAPKGDATKKGDAKSQALKTAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2693 - protein, 154 aa, Lactuca sativa; identical to SEQ ID NO: 2691

SEQ ID NO: 2694 - protein, 154 aa, Lactuca sativa
MSPAKADTTKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2695 - protein, 153 aa, Lactuca sativa
MAPKGDTTKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2696 - protein, 154 aa, Lactuca sativa
MSPAKVDATKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2697 - protein, 154 aa, Lactuca sativa; identical to SEQ ID NO: 2694

SEQ ID NO: 2698 - protein, 154 aa, Lactuca sativa; identical to SEQ ID NO: 2691

SEQ ID NO: 2699 - protein, 152 aa, Leymus cinereus x Leymus triticoides
MAPKAAVAKKGDAKAQAAKVAKAVKSGSIKKTAKKIRTSVTFHRPKTLSKPRDPKYPRISTPGRNKLDQYQILKYPLTTESAMKKIEDNNTLVFIVDLKADKKKIKAAVKKMYDIQANKVNTLIRPDGKKKAYVKLTPDYDALDVANKIGII

SEQ ID NO: 2700 - protein, 155 aa, Glycyrrhiza uralensis
MAPTKGDKAKKADPKAQALKAAKAVKSGGQLIKKKAKKIRTTVTFHRPKTLTKERNPKYPRISATPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2701 - protein, 156 aa, Liriodendron tulipifera
MAPPTKAAATKKADPKAQALKAAKAVKSGASTLKKKAKKIRTSVTFHRPKTLKKERNPKYPRISAPPRNKLDHYQILKYPLTTESAMKKIEDNNTLVFIVDLRADKKKIKAAVKKMYDIQTKKVNTLIRPDGTKKAYVRLTPDYDALDVANKIGII

SEQ ID NO: 2702 - protein, 152 aa, Lolium multiflorum
MAPKAAVAKKGDAKAQAVKVAKAVKSGSIKKTAKKIRTSVTFHRPRTLKKARDPKYPRVSTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2703 - protein, 153 aa, Lotus japonicus
MAPKADSSKKNDPKAQALKAAKAVKSGTTIKKKTKKIRTTVTFHRPKTLTKTRNPKYPRISATPRNKLDHYQILKFPLTTESAMKKIEDNNTLVFIVDLRADKKKIKAAVKKMYDIQAKKVNTLIRPDGTKKAYVRLTPDYDALDVANKIGII

SEQ ID NO: 2704 - protein, 155 aa, Lotus japonicus
MSPAKADTTKKADAKAQALKTAKAVKSGGKVIKKKAKKIRTTVTFHRPKTLTKERNPKYPRISATPRNKLDHYQILKFPLTTESAMKKIEDNNTLVFIVDIRADKKKIKAAVKKMYDIQAKKVNTLIRPDGTKKAYVRLTPDYDALDVANKIGII

SEQ ID NO: 2705 - protein, 153 aa, Lotus japonicus
MAPKADGSKKTDPKAQALKTAKAVKSGPTFKKKAKKIRTTVTFHRPKTQTKDRNPKYPRISATPRNKLDHYQILKFPLTTESAMKKIEDNNTLVFIVDLRADKKKIKAAVKKMYDIQAKKVNTLIRPDGTKKAYVRLTPDYDALNVANKIGII

SEQ ID NO: 2706 - protein, 152 aa, Eragrostis curvula
MAPKAAVAKKGDGNAQAMKVAKAVKSGQVKKKTKKIRTSVTFHRPKTLKKPRDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2707 - protein, 151 aa, Eragrostis curvula
MAPKAPPKKADGKTQALKVAKAVKSGAAKRKAKKIRTSVTFHRPKTLKKPRDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2708 - protein, 152 aa, Zea mays
MAPKAAPVKKGDAKAQALKVAKAVKSGAGKKKTKKIRTSVTFHQPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2709 - protein, 151 aa, Zea mays
MAPKAAPAKKGDAKTQALKVAKAVKSGSVKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLMPDYDALDVANKIGII

SEQ ID NO: 2710 - protein, 69 aa, Zea mays
MKKIEDNNTLVFIVDLKADKKKIKAAAKMYDIQAKKVNTLIKPDGKKKAYVKPMPDYDALDVARCLLDS

SEQ ID NO: 2711 - protein, 151 aa, Zea mays
MAPKAAPAKKGDAKTQALKVAKAVKSGAAKKTKKIRTSVTFHRPTTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2712 - protein, 152 aa, Zea mays
MAPKVAVAKKGDAKAQAAKVAKAVKSGSIKKTAKKIRTSVTFHRPKTLSKARDPKYPRISTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2713 - protein, 154 aa, Zea mays; identical to SEQ ID NO: 2625

SEQ ID NO: 2714 - protein, 152 aa, Zea mays
MAPKAAPAKKGDAKTQALKVAKAVKSGAAKKKTKKIRTSVTFHRPTTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2715 - protein, 154 aa, Medicago truncatula
MAPPKGDGAKKTDPKAQALKAAKAVKSGTAIKKKAKKIRTTVTFHRPKTLSRDRNPKYPRISATPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2716 - protein, 152 aa, Medicago truncatula
MAPKGDVSKKTDPKAQALKAAKAVKSGTAIKKAKKIRTTVTFHRPKTQTKDRNPKYPRISATPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2717 - protein, 124 aa, Medicago truncatula
MAPPKGENAKKADPKAKALKTAKAVKSGQVIKKKTKKIRTTVTFHRPKTLSRERNPKYPRISATPRNKLDHYQILKFPLTTESAMKKIEDNNTLVFIVDLRADKKKIKDAVKKCMIFRPRKLTL

SEQ ID NO: 2718 - protein, 153 aa, Cucumis melo
MAPKADSTKKADPKAQALKTAKAVKSGPTFKKKAKKIRTSVTFHRPKTLKKERNPKYPRISVTPRNKLDQYQILKYPLTTESAMKKIEDNNTLVFIVDIRADKKKIKDAVKKMYDIQTKKVNTLIRPDGTKKAYVRLTPDYDALDVANKIGII

SEQ ID NO: 2719 - protein, 153 aa, Cucumis melo; identical to SEQ ID NO: 2665

SEQ ID NO: 2720 - protein, 152 aa, Pennisetum glaucum
MAPKAALAKKGDAKAQAIKVAKAVKSGTIKKKTKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2721 - protein, 151 aa, Pennisetum glaucum
MAPKAPPKKADAKAQALKVAKAVKSGTTKTKAKKIRTSVTFHRPKTLKKPRDPKYPRISAPGRNKLDQYQILKYPLTTESAMKKIEDNNTLVFIVDIKADKKKIKAAVKKMYDIQAKKVNTLIRPDGKKKAYVKLTPDYDALDVANKIGII

SEQ ID NO: 2722 - protein, 155 aa, Mimulus guttatus
MAPAKVDNAKKSDPKAQALKTAKAVKAGSTAFKKKSKKIRTKVTFYRPRTLKKDRTPKYPRISAPPRNKLDHYQILKYPLTTESAMKKIEDNNTLVFIVDIRADKKKIKAAVKKMYDIHTKKVNTLIRPDGTKKAYVRLTPDYDALDVANKIGII

SEQ ID NO: 2723 - protein, 155 aa, Mimulus guttatus
MAPAKVDNAKKSDPKAQALKTAKAVKAGSTAFKKKSKKIRTKVTFYRPRTLKKDRSPKYPRISAPPRNKLDHYQILKYPLTTESAMKKIEDNNTLVFIVDIRADKKKIKAAVKKMYDIHTKKVNTLIRPDGTKKAYVRLTPDYDALDVANKIGII

SEQ ID NO: 2724 - protein, 154 aa, Nicotiana benthamiana
MAPAKADPSKKSDPKAQAAKVAKAVKSGSTFKKKSQKIRTKVTFHRPKTLKKDRNPKYPRISAPGRNKLDQYGILKYPLTTESAMKKIEDNNTLVFIVDIKADKKKIKDAVKKMYDIQTKKVNTLIRPDGTKKAYVRLTPDYDALDVANKIGII

SEQ ID NO: 2725 - protein, 155 aa, Nuphar advena
MAPPAKAPAKKSDAKSQALKAAKAVKSGSLTLKKKAKKIRTSVTFHRPKTLKRERNPKYPRISAPPRNKLDHYQILKYPLTTESAMKKIEDNNTLVFVVDLRADKKKIKAAVKKMYDIQAKKVNTLIRPDGTKKAYVRLTPDYDALDVANKIGII

SEQ ID NO: 2726 - protein, 154 aa, Quercus alba; identical to SEQ ID NO: 2645

SEQ ID NO: 2727 - protein, 154 aa, Quercus alba; identical to SEQ ID NO: 2644

SEQ ID NO: 2728 - protein, 152 aa, Avena sativa
MAPKAAVAKKGDAKAQAMKVAKAVKSGSIMKTAKKIRTSVTFHRPKTLKKARDPKYPRISTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2729 - protein, 156 aa, Elaeis guineensis
MAPPAKAATAKKPDGKAQALKVAKAVKSGASSLKKKTKKIRTSVTFHRPKTLKKERNPKYPRISAPPRNKLDQYQILKYPLTTESAMKKIEDNNTLVFIVDIRADKKKIKAAVKKMYDIQAKKVNTLIRPDGTKKAYVRLTPDYDALDVANKIGII

SEQ ID NO: 2730 - protein, 155 aa, Elaeis guineensis
MAPPAKATSKKPDGKTQALKVAKAVKSGASSLKRKTKKIRTSVTFHRPKTLKKERNPKYPRISAPPRNKLDHYQILKYPLTTESAMKKIEDNNTLVFIVDIRADKKKIKAAVKKMYDIQAKKVNTLIRPDGTKKAYVRLTPDYDALDVANKIGII

SEQ ID NO: 2731 - protein, 155 aa, Allium cepa
MAPPTKATTKKADAKAQALKAAKAIKSGDSSIKKKAKKIRTSVTFHRPKTLKLPRNPKYPRISAPPRNKLDHYQILKYPLTTESAMKKIEDNNTLVFIVDIRADKKKIKAAVKKMYDIQAKKVNTLIRPDGTKKAYVRLTPDYDALDVANKIGII

SEQ ID NO: 2732 - protein, 154 aa, Carica papaya
MPPPKGDSSKKADPKAQAMKAAKVVKSGPTFKKKAKKIRTSVTFHRPKTLKKDRNPKYPRISAPGRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2733 - protein, 153 aa, Carica papaya
MAPKADGTKKADPKAQAVKAAKVVKSGPTFKKKAKKIRTKVTFHRPKTLTKERNPKYPRISAPGRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2734 - protein, 154 aa, Arachis hypogaea
MAPAKVDSSKKADPKAQALKTAKAVKSGATFKKKAKKIRTKVTFHRPKTLKKDRNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2735 - protein, 155 aa, Arachis hypogaea
MAPAKADNTKKADPKAQALKAAKAVKSGGKVFKKKANKIRTKVTFHRPKTLKKDRNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2736 - protein, 154 aa, Arachis hypogaea
MAPAKVDNSKKNDPKAQALKTAKAVKSGSTFKKKAKKIRTKVTFHRPKTLKKDRNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2737 - protein, 152 aa, Pisum sativum
MAPPKGEKKTDPKAQALKAAKAVKSGSAIKKKAKKIRTTVTFHRPKTQTKDRNPKYPRISATPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2738 - protein, 153 aa, Capsicum annuum
MAPKGDSTKKTDPKAQAVKAAKAVKSGSTSKKKSQKIRTKVTFHRPRTLKKDRNPKYPRVSAPGRNKLDQYAILKYPLTTESAMKKIEDNNTLVFIVDLKADKKKIKDAVKKMYDIQTKKINTLIRPDGTKKAYVRLTPDYDALDVANKIGII

SEQ ID NO: 2739 - protein, 154 aa, Capsicum annuum
MAPAKADLTKKNDPKAQAVKVSRAVKSGSTFKKKSNKIRTKVTFHRPKTLKKDRNPKYPRISAPGRNRLDQYQILKHPLTTESAMKKIEDNNTLVFIVDIHSDKKKIKDAVKKMYDIQIKKVNTLIRPDGTKKAYVRLTPDYDALDVANKIGII

SEQ ID NO: 2740 - protein, 153 aa, Petunia hybrida
MAPKADSSKKSDPKAQAAKVAKAVKSGSTFKKKSQKIRTKVTFHRPKTLKKDRNPKYPRVSAPGRNKLDQYGILKFPLTTESAMKKIEDNNTLVFIVDIKANKKMIKDAVKKMYDIQTKKVNTLIRPNGTKKAYVRLTPDYDALDVANKIGII

SEQ ID NO: 2741 - protein, 152 aa, Petunia hybrida
MAPKADTKKADPKAQAAKVAKAVKSGSTFKKKSQKIRTKVTFHRPKTLKKDRNPKYPRISATPRNKLDQYAILKYPLTTESAMKKIEDNNTLVFIVDIKADKKKIKDAVKKMYDIQTKKINTLIRPNGTKKAYVRLTPDYDALDVANKIGII

SEQ ID NO: 2742 - protein, 154 aa, Petunia hybrida
MAPPKADSTKKADPKAQAAKVAKAVKSGAMFKKKSKKIRTKVTFHRPRTLRKERNPKYPRISATPRNKLDHYQILKYPLTTESAMKKIEDNNTLVFIVDIHADKKKIKDAVKKMYDIQTKKVNTLIRPDGTKKAYVRLTPDYDALDVANKIGII

SEQ ID NO: 2743 - protein, 153 aa, Populus trichocarpa
MSPARADASKKPDAKAQAQKAARAVKSGPTFKKTKKIRTKVTFHRPRTLKKERNPKYPRISATPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2744 - protein, 151 aa, Populus trichocarpa
MAPKDVKKADAKTQAQKAAKALKSGAPAFKKSKKIRTKVTFHRPRTLKKERNPKYPRISATPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2745 - protein, 113 aa, Populus trichocarpa
MAPAKDSLKKADAKAQAVKAARAVKSGPTFKKTKKIRTKVTFHRPRTLKKERNPKYPRISATPRNKLDHYQILKYPLTTESAMKKIEDNNTLVFIVDLRADKKKNQGCCQEDV

SEQ ID NO: 2746 - protein, 155 aa, Papaver somniferum
MAPPSKVATKKADPKVQALKSAKAVKAGASTLKKKIKKIRTSVTFHRPKTLKTARKPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2747 - protein, 155 aa, Papaver somniferum
MAPPAKVTSKKVDPKVQANKAAKAVKAGASTIKKKAKKIRTSVTFHRPKTLQKARNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2748 - protein, 153 aa, Solanum tuberosum
MAPKADSTKKSDPKAQAVKAAKAVKSGSTFKKKSQKIRTKVTFHRPRTLKKDRSPKYPRVSAPGRNKLDQYAILKYPLTTESAMKKIEDNNTLVFIVDIKADKKKIKAAVKKMYDIQTKKINTLIRPDGTKKAYVRLTPDYDALDVANKIGII

SEQ ID NO: 2749 - protein, 153 aa, Solanum tuberosum; identical to SEQ ID NO: 2748

SEQ ID NO: 2750 - protein, 154 aa, Solanum tuberosum
MAPAKADLTKKKDPKAQAVKAAKAVKSGSTFKKKSSKIRTKVTFHRPKTLKKDRNPKYPRISAPGRNRLDQYQVLKCPLTTESAMKKIEDNNTLVFIVDIHADKKKIKDAVKKMYDIQIKKVNTLIRPDGTKKAYVRLTPDYDALDVANKIGII

SEQ ID NO: 2751 - protein, 154 aa, Solanum tuberosum; identical to SEQ ID NO: 2750

SEQ ID NO: 2752 - protein, 154 aa, Prunus persica
MAPAKADNTKKSDPKAQALKTAKAVKSGPTFKKKAKKIRTSVTFHRPRTLKKERNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2753 - protein, 154 aa, Prunus persica
MAPTKADVSKKADPKSQAVKAAKALKSGPILKKKAKKIRTSVTFHRPRTLKKERNPKYPRISAPPRNKLDHYQILKYPLTTESAMKKIEDNNTLVFIVDIRADKKKIKDAVKKMYDIQSKKVNTLIRPDGTKKAYVRLTPDYDALDVANKIGII

SEQ ID NO: 2754 - protein, 152 aa, Pseudoroegneria spicata
MAPKVAVAKKGDAKAQAAKVAKAVKSGSIKKTAKKIRTSVTFHRPKTLSKPRDPKYPRISTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2755 - protein, 154 aa, Raphanus sativus
MSPAKVDVTKKVDPKAKALKAAKAVKSGQVIKKKAKTIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2756 - protein, 154 aa, Raphanus sativus; identical to SEQ ID NO: 2589

SEQ ID NO: 2757 - protein, 154 aa, Raphanus sativus; identical to SEQ ID NO: 2589

SEQ ID NO: 2758 - protein, 154 aa, Raphanus sativus; identical to SEQ ID NO: 2589

SEQ ID NO: 2759 - protein, 154 aa, Raphanus sativus
MSPAKVDVTKKADPKAKALKAAKAVKSGQIIKKKAKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2760 - protein, 154 aa, Raphanus sativus; identical to SEQ ID NO: 2589

SEQ ID NO: 2761 - protein, 154 aa, Raphanus sativus; identical to SEQ ID NO: 2589

SEQ ID NO: 2762 - protein, 154 aa, Raphanus sativus; identical to SEQ ID NO: 2589

SEQ ID NO: 2763 - protein, 154 aa, Raphanus sativus
MAPAKVDVTKKADPKAKALKAAKAVKSGQIIKKKVKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2764 - protein, 154 aa, Raphanus sativus; identical to SEQ ID NO: 2589

SEQ ID NO: 2765 - protein, 154 aa, Raphanus sativus; identical to SEQ ID NO: 2589

SEQ ID NO: 2766 - protein, 153 aa, Raphanus sativus
MSPAKVDTTKADPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2767 - protein, 154 aa, Raphanus sativus; identical to SEQ ID NO: 2593

SEQ ID NO: 2768 - protein, 154 aa, Raphanus sativus
MSPAKVDATKKADPKAKALKAAKAVKSGQAFKKKDKKIRTKVTFHRPKTLTKARDPKYPRISATPRNKLDHYGILKYPLTTESAMKKIEDNNTLVFIVDIRADKKKIKDAVKKMYDIQTKKVNTLIRPDGTKKAYVRLTPDYDALDVANKIGII

SEQ ID NO: 2769 - protein, 152 aa, Oryza sativa
MAPKAAVKKADGKTQQALKVAKAVKSGSIKRKSKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2770 - protein, 152 aa, Oryza sativa
MAPKAAPAKKGDAKAQALKAAKAVKSGTAKKTTKKIRTSVTFHRPKTLKKSRDPKYPRVSTPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2771 - protein, 152 aa, Secale cereale; identical to SEQ ID NO: 321

SEQ ID NO: 2772 - protein, 153 aa, Carthamus tinctorius
MAPKADSTKKGDAKAQALRTTKAVKTGSTFKKKAKKIRTKVTFFRPRTLKTDRNPKYPRISAPPRNKLDHYQILKYPLTTESAMKKIEDNNTLVFIVDIRADKKKIKAAMKKMYDIQTKKVNTLIRPDGTKKAYVRLTPDYDALDVANKIGII

SEQ ID NO: 2773 - protein, 154 aa, Carthamus tinctorius
MAPAKGDVTKKGDAKAQALKAAKAVKTGSTFKKKAKKIRTKVTFFRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2774 - protein, 148 aa, Carthamus tinctorius
MLQKKGDAKAQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2775 - protein, 136 aa, Senecio madagascariensis
MKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2776 - protein, 154 aa, Solanum phureja; identical to SEQ ID NO: 2750

SEQ ID NO: 2777 - protein, 70 aa, Solanum phureja
MKKIEDNNTLVFIVDIHADKKKIKDAVKKMYDIQAKKVNTLIRPDGTKKAYVRLTPDYDALDVANKIGII

SEQ ID NO: 2778 - protein, 153 aa, Solanum phureja; identical to SEQ ID NO: 2748

SEQ ID NO: 2779 - protein, 152 aa, Sorghum bicolor
MAPKAAPAKKGDAKTQALKVAKAVKSGSVKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2780 - protein, 152 aa, Sorghum bicolor
MAPKAAPAKKADAKAQALKVAKAVKSGAGKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2781 - protein, 151 aa, Glycine max
MAPKVDKKNDPKAQALKTAKAVKSGATFKKKAKKIRTSVTFHRPRTLKKDRNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2782 - protein, 153 aa, Glycine max
MAPKADSSKKADPKAQALKTAKAVKSGANFKKKTKKIRTSVTFHRPRTLKKDRNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2783 - protein, 151 aa, Glycine max
MAPKVDKKNDPKAQALKTAKAVKSGATFKKKVKKIRTSVTFHRPKTLKKDRNPKYPRISAPPRNKLDHYQILKYPLTTESAMKKIEDNNTLVFIVDLRADKKKIKDAVKKMYDIQAKKVNTLIRPDGTKKAYVRLTPDYDALDVANKIGII

SEQ ID NO: 2784 - protein, 155 aa, Glycine max
MAPTKVDNAKRADPKAQALKTAKAVKSSGQVFRKKAKKIRTSVTFHRPRTLKKERNPKYPRISAPPRNKLDHYQILKFPLTTESAMKKIEDNNTLVFIVDLRANKKKIKDAVKKMYDIQAKKVNTLIRPDGTKKAYVRLTPDYDALDVANKIGII

SEQ ID NO: 2785 - protein, 155 aa, Glycine max
MAPAKADNAKKADPKAQALKTAKAVKSGGQVFKKKAKKIRTSVTFHRPRTLKKERNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 2786 - protein, 153 aa, Glycine max
MAPKADSLKKADPKAQALKTAKAVKSGATLKKKTKKIRTSVTFHRPKTLKKDRNPKYPRISAPPRNKLDHYQILKYPLTTESAMKKIEDNNTLVFIVDLRADKKKIKDAVKKMYDIQTKKVNTLIRPDGTKKAYVRLTPDYDALDVANKIGII

SEQ ID NO: 2787 - protein, 154 aa, Euphorbia esula
MAPAKADGSKKPDAKAQAVKAAKAVKSGPTFKKKGKKIRTKVTFHRPRTLKKERNPKYPRISAPPRNKLDQYQILKYPLTTESAMKKIEDNNTLVFIVDIRADKKKIKDAVKKMYDIQAKKVNTLIRPDGTKKAYVRLTPDFDALDVANKIGII

SEQ ID NO: 2788 - protein, 152 aa, Fragaria vesca
MAPKVDSKKADPKAQALKAAKAVKSGQTFKKKAKKIRTSVTFHRPRTLKKERNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2789 - protein, 154 aa, Fragaria vesca
MAPPKGDVSKKGDPKSQALKAAKALKSGPAVKKTGKKIRTSVTFHQPKTLKKERNPKYPRISAPPRNKLDHYQILKYPLTTESAMKKIEDNNTLVFIVDIRADKKKIKDAVKKMYDIQTKKVNTLIRPDGTKKAYVRLTPDFDALDVANKIGII

SEQ ID NO: 2790 - protein, 152 aa, Saccharum officinarum; identical to SEQ ID NO: 2779

SEQ ID NO: 2791 - protein, 152 aa, Saccharum officinarum
MAPKATPAKKADAKAQALKVAKAVKSGAGKKKTKKIRTSVTFHRPKTLKKARDPKYPRISTTGRNKLDQYQILKYPLTTESAMKKIEDNNTLVFIVDLKADKKKIKSAVKKMYDIQAKKVNTLIRPDGKKKAYVKLTPDYDALDVANKIGII

SEQ ID NO: 2792 - protein, 152 aa, Saccharum officinarum
MSPKAAPAKKGDAKTQALKVAKAVKSGSVKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2793 - protein, 152 aa, Saccharum officinarum
MAPKAAPAKKADAKAQALKVAKAVKSGAAKKKTKKIRTSVTFHRPKTLKKARDPKYPRISTTGRNKLDQYQILKYPLTTESAMKKIEDNNTLVFIVDLKADKKKIKSAVKKMYDIQAKKVNTLIRPDGKKKAYVKLTPDYDALDVANKIGII

SEQ ID NO: 2794 - protein, 152 aa, Saccharum officinarum; identical to SEQ ID NO: 2779

SEQ ID NO: 2795 - protein, 152 aa, Saccharum officinarum
MAPKAAPAKKADAKAQALKVAKAVKSGAGKKKTKKIRTSVTFHRPKTLKKARDPKYPRISTTGRNKLDQYQILKYPLTTESAMKKIEDNNTLVFIVDLKADKKKIKSAVKKMYDIQAKKVNTLIRPDGKKKAYVKLTPDYDALDVANKIGII

SEQ ID NO: 2796 - protein, 126 aa, Saccharum officinarum
MAPKAAPAKKGDAKTQALKVAKAVKSGSVKKKTKKIRTSVTFHRPKTLKKARDPKYPRISTTGRNKLDQYQILKYPLTTESAMKKIEDNNTLVFIVDLNADKKKIKAAVKKMYDISGQEGQHPDQA

SEQ ID NO: 2797 - protein, 153 aa, Helianthus annuus
MAPKADNAKKTDAKSQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2798 - protein, 153 aa, Helianthus annuus
MAPKADTTKKGDGKAQALKAAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2799 - protein, 153 aa, Helianthus annuus
MAPKADVAKKADAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2800 - protein, 154 aa, Helianthus annuus
MSPAKVAATKKGDAKAQALKTAKAVKTGSTFKKKAKKIRTKVTFHRPRTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2801 - protein, 151 aa, Panicum virgatum
MAPKAAPAKKDAKTQALKVAKAVKSGAVKKKTKKIRTSVTFHRPKTLKKARDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2802 - protein, 151 aa, Panicum virgatum
MAPKAPPKKADSKAQALKVAKAVKSGSTKRKTKKIRTSVTFHRPKTLKKPRDPKYPRVSAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2803 - protein, 151 aa, Panicum virgatum
MAPKAPPKKADSKAQALKVAKAVKSGTTKRKAKKIRTSVTFHRPKTLKKPRDPKYPRISAPGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 2804 - protein, 151 aa, Panicum virgatum; identical to SEQ ID NO: 2801

SEQ ID NO: 2805 - protein, 99 aa, Camellia sinensis
MAPAKADPAKKSDAKAQASKAAKAVKSGSSTFKKKAKKIRTTVTFHRPRTLKKDRNPKYPRISATPRNKLDQYQILKYPLTTESAMKKIEDNNTLVFHC

SEQ ID NO: 2806 - protein, 153 aa, Camellia sinensis
MARGRGTKKADPKAQALKAAKAVKSGSSTLKKKVKKIRTTVTFHRPRTLKKDRNPKYPRISAPPRNKLDHYQILKYPLTTESAMKKIEDNNTLVFIVDIRADKKKIKDAVKKMYDIQTKKVNTLIRPDGTKKAYVRLTPDYDALDVANKIGII

SEQ ID NO: 2807 - protein, 154 aa, Thellungiella halophila; identical to SEQ ID NO: 2589

SEQ ID NO: 2808 - protein, 154 aa, Nicotiana tabacum
MAPAKAVSTKKADPKAQAAKVAKAVKSGSTFKKKSNKIRMKVTFHRPKTLKKERNPKYPRISATPRNKLDHYGILKYPLTTESAMKKIEDNNTLVFIVDLKADKKKIKDAVKKMYDIQTKKVNTLVRPDGTKKAFVRLTPDYDALDVANKIGII

SEQ ID NO: 2809 - protein, 154 aa, Nicotiana tabacum
MAPAKADPSKKSDPKAQAAKVAKAVKSGSTFKKKSQKIRTKVTFHRPKTLKKDRNPKYPRISAPGRNKLDQYGILKYPLTTESAMKKIEDNNTLVFIVDIKADKRKIKDAVKKMYDIQTKKVNTLIRPDGTKKAYVRLTPDYDALDVANKIGII

SEQ ID NO: 2810 - protein, 153 aa, Nicotiana tabacum
MAPAKDVAKKGDPKAQAVKAAKAVKSGSTFKKKSTKIRTKVTFHRPKTLKKDRNPKYPRISAPGRNKLDQYGILKYPLTTESAMKKIEDNNTLVFIVDIKADKKKIKDAVKKMYDIQTKKVNTLIRPDGTKKAYVRLTPDYDALDVANKIGII

SEQ ID NO: 2811 - protein, 154 aa, Nicotiana tabacum
  misc_feature (78)..(78): Xaa can be any naturally occurring amino acid
MAPAKVDLAKKKDPKAQAVKAAKAVKSGSTFKKKSTKIRTKVTFHRPKTLKKDRNPKYPRISAPGRNKLDQYGILKYXLTTESAMKKIEDNNTLVFIVDIKADKKKIKDAVKKMYDIQTKKVNTLIRPDGTKKAYVRLTPDYDALDVANKIGII

SEQ ID NO: 2812 - protein, 154 aa, Nicotiana tabacum
MAPAKADPSKKSDPKAQAAKVAKAVKSGSTLKKKSQKIRTKVTFHRPKTLKKDRNPKYPRISAPGRNKLDQYGILKYPLTTESAMKKIEDNNTLVFIVDIKADKKKIKDAVKKMYDIQTKKVNTLIRPDGTKKAYVRLTPDYDALDVANKIGII

SEQ ID NO: 2813 - protein, 154 aa, Solanum lycopersicum
MAPAKVDLTKKKDPKAQAVKAAKAVKSGSTFKKKSSKIRTKVTFHRPKTLKKDRNPKYPRISAPGRNRLDQYQVLKCPLTTESAMKKIEDNNTLVFIVDIHADKKKIKDAVKKMYDIQIKKVNTLIRPDGTKKAYVRLTPDYDALDVANKIGII

SEQ ID NO: 2814 - protein, 154 aa, Solanum lycopersicum
MAPAKADVIKKGDPKAQAVKAAKAVKSGSTFKKMSKRIRTKVTFHRPKTLKKDRNPKYPRISAPGRNRLDQYQILQCPLTTESAMKKIEDNNTLVFIVDIHADKKKIRDAVKKMYDIQAKKVNTLIRPDGTKKAYVRLTPDYDALDVANKIGII

SEQ ID NO: 2815 - protein, 153 aa, Solanum lycopersicum; identical to SEQ ID NO: 2748

SEQ ID NO: 2816 - protein, 152 aa, Triticum aestivum; identical to SEQ ID NO: 2712

SEQ ID NO: 2817 - protein, 152 aa, Triticum aestivum; identical to SEQ ID NO: 2712

SEQ ID NO: 2818 - protein, 152 aa, Triticum aestivum; identical to SEQ ID NO: 2712

SEQ ID NO: 2819 - protein, 125 aa, Triticum aestivum
  misc_feature (2)..(2): Xaa can be any naturally occurring amino acid
KXTRASCRIRHGSIKKTAKKIRTSVTFHRPKTLSKARDPKYPRISTPGRNKLDQYQILKYPLTTESAMKKIEDNNTLVFIVDLKADKKKIKAAVKKMYDIQAKKVNTLIRPDGKKKAYVKLTPRL

SEQ ID NO: 2820 - protein, 153 aa, Zinnia violacea
MVSKGDSTKKANAKAQALKVAKAVKTGSTFKKKAKKIRTKVTFHRPKTLKTDRNPKYPRISAPPRNKLDHYQILKYPLTTESAMKKIEDNNTLVFIVDIRADKKKIKAAVKKMYDIQTKKVNTLIRPDGTKKAYVRLTPDYDALDVANKIGII

SEQ ID NO: 2821 - protein, 369 aa, Malus domestica
MEITNVSEYEAIAKEKLPKMVYDYYASGAEDQWTLAENRNAFARILFRPRILIDVSRIDMTTTVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKAADSGLASYVAGQIDRSLSWKDVQWLQTITSLPILVKGVLTAEDARIAVQAGAAGIIVSNHGARQLDYVPSTIMALEEVVKGAQGRIPVFLDGGVRRGTDVFKALALGASGIFIGRPVVFSLAAEGEAGIRKVLQMLREEFELTMALSGCRSLKEITRDHIVTDWDAPRPRHQPRL

SEQ ID NO: 2822 - protein, 147 aa, Musa acuminata
MEITNVMEYEAVAKQKLPKMVFDYYASGAEDQWTLKENREAFSRILFRPRILIDVSRIDMTTTVLGFKISMPIMIAPTAMQKMAHPEGEYATARAASAAGTIMTLSSWATSSVEEVASTGPGIRFFQLYVYKDRNVVAQLVRRAERA

SEQ ID NO: 2823 - protein, 373 aa, Brachypodium distachyon
MGVELITNVSEYEKLAKEKLPKMVYDYYASGAEDQWTLKENRDAFSRILFRPRVLIDVSHINMATNVLGFNISMPIMIAPTAMQRMAHPEGELATARAAASAGTIMTLSSWATSSVEEVNSVGPGIRFFQLYVYKDRTIVRQLVRRAEMAGFKAIALTVDTPRLGRREADIKNRFTLPPHLVLKNFEGLDIGTMDKTNDSGLASYVASQVDRSLCWEDVKWLQTITSLPILVKGVMTAEDTRLAVENGAAGIIVSNHGARQLDYVPATISCLEEVVREAKGRLPVFLDGGVRRGTDVFKALALGAAGVFIGRPVLYSLAVDGEAGVRKVLQMLRDELEIAMALSGCTSLREITRAHVLVAADADTTVPRRARL

SEQ ID NO: 2824 - protein, 367 aa, Manihot esculenta
MEITNVMEYEEIAKQKLPKMVFDYYASGAEDQWTLKENRNAFSRILFRPRILIDVSKIDMTTSVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKADDSGLASYVAGQIDRTLSWKDVKWLQTITSLPILVKGVLTAEDARLSIQNGAAGIIVSNHGARQLDYVPATIMALEEVVKAAQGRVPVFLDGGVRRGTDVFKALALGASGIFIGRPVVFSLAAEGEAGIRKVLQMLREEFELTMALSGCRSLREITRNHIVADWDLPRPVPRL

SEQ ID NO: 2825 - protein, 367 aa, Manihot esculenta
MEITNVMEYEEIARQKLPKMVFDYYASGAEDQWTLKENRNAFSRILFRPRILIDVSKIDMTTSVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKADDSGLASYVAGQIDRTLSWKDVQWLQTITSLPILVKGVLTAEDTRLAIQNGAAGIIVSNHGARQLDYVPATIMALEEVVKAAQGRVPVFLDGGVRRGTDVFKALALGASGIFIGRPVVFSLAAEGETGIRKVLQMLREEFELTMALSGCRSLREITRNHIVTDWDLPHPVARL

SEQ ID NO: 2826 - protein, 369 aa, Ricinus communis
MEITNVMEYEEIARQKLPKMVYDYYASGAEDQWTLKENRNAFSRILFRPRILIDVSKIDMTTSVLGFKISMPIMIAPTAMQKMAHPEGEYATARAASAAGTIMTLSSWATSSVEEVASTGPGIRFFQLYVYRDRNVVAQLVRRAERAGFKAIALTVDTPRLGRREADIKNRFTLPPFLTLKNFEGLDLGKMDKSDDSGLSSYVAGQIDRTLSWKDIKWLQTITSLPILVKGVLTAEDTRLAIQNGAAGIIVSNHGARQLDYVPATIMALEEVVKAAQGRVPVFLDGGVRRGTDVFKALALGASGIFIGRPVVFSLAAEGEAGIRKVLQMLRDEFELTMALSGCRSLREITRDHIVTDWDLPRPVASARL

SEQ ID NO: 2827 - protein, 367 aa, Castanea mollissima
MEITNVTEYEAIAKEKLPKMVYDYYASGAEDQWTLKENRNAFSRILFRPRILVDVSKIDMATTILGFKISMPIMIAPTAMQKMAHPEGEYATARAASAAGTIMILSSWATSSVEEVASTGPGIRFFQLYVYKDRNVVAQLVRRAERAGFNAIALTVDTPRLGRRESDIKNRFVLPPYLTLRNFDGLNLGTMDKTNDSGLASYVAGQIDRSLSWKDVKWLQTITKLPILVKGVLTAEDTRLAIQAGAAGIIVSNHGARQLDYVPATIMALEEVVKAAQGRVPVFLDGGIRRGTDVFKALALGASGIFIGRPVVFSLAAEGEAGVRKVLQMLRDEFELTMALSGCRSLKEITRDHIVTEWDRPNLSPRL

SEQ ID NO: 2828 - protein, 369 aa, Castanea mollissima
MEITNVSEYEAIAKQKLPKMVFDYYASGAEDQWTLAENRNAFSRILFRPRILIDVSKIDMTTTVLGFKISMPIMIAPTAMQKMAHPEGEYATARAASAAGTIMTLSSWATSSVEEVASTGPGIRFFQLYVYKDRHVVAQLVRRAERAGFKAIALTVDTPRLGRREADIKNRFTLPPYLTLKNFEGLDLGKMDKSNDSGLASYVAGQIDRSLSWKDVKWLQTITKLPILVKGVLTAEDARLAVQAGAAGIIVSNHGARQLDYVPATILALEEVVKAAQGRVPVFLDGGVRRGTDVFKALALGASGVFFGRPVLYSLAAEGEAGVRKVLQMLREEFELTMALSGCRSLNEITRNHVVTDWDLPHPRPLPRL

SEQ ID NO: 2829 - protein, 371 aa, Citrus sinensis
MTYISEITNVMEYEALAKEKLPKMVYDYYASGAEDQWTLQENRNAFSRILFRPRILRDVSKIDMTTTVLGFNISMPIMIAPTAFQKMAHPEGECATARAASAAGTIMTLSSWATSSVEEVSSTGPGIRFFQLYVTKDRNVDAQLVKRAERAGFKAIALTVDTPRLGRREADIKNRFVLPPHLTLKNYEGLYIGKMDKTDDSGLASYVANQIDRSLNWKDVKWLQTITSLPILVKGVLTAEDASLAIQYGAAGIIVSNHGARQLDYVPATVMALEEVVQAAKGRVPVFLDGGVRRGTDVFKALALGASGVFVGRPVPFSLAVDGEAGVRKVLQMLRDEFELTMALSGCRSLKEITRNHIVTHWDTPGAVARL

SEQ ID NO: 2830 - protein, 368 aa, Gossypium hirsutum
  misc_feature (204)..(204): Xaa can be any naturally occurring amino acid
  misc_feature (361)..(361): Xaa can be any naturally occurring amino acid
MEMITNVSEYEVIAKEKLPKMVYDYYASGAEDQWTLKENRNAFSRILFRPRILIDVSKINMMTTILGFRISMPIMVAPTAMQKMAHPEGECATARAASDAGTIMTLSSYANSSVEEVASTGSGIRFFQLYVHKDRNLVAQLVRRAERAGFKAIALTADTPRLGRREADIKNRFTLPPYLTLKNFEGLDLGKIDKTDDSGLASYXANQIDQSLSWKDVKWLQTITSLPILVKGVLTAEDTKLAIEAGAAGIIVSNHGARQLDYVPATIMALEEVVKAAQGKVPVFLDGGVRRGTDVFKALALGASGIFIGRPVVFALAVDGEAGVRKVLQMLHDELELTMALSGCRSLKEITRNHVVADWDXPRVLPRL

SEQ ID NO: 2831 - protein, 369 aa, Gossypium hirsutum
MEITNVSEYQEIAKQKLPKMVYDYYASGAEDQWTLQENRFAFTKILFRPRILIDVSKIDMTTTVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDQADDSGLASYVAGQIDRSLSWKDVKWLQTITKLPILVKGVLTAEDTRIAIQAGAAGIIVSNHGARQLDYVPATIMALEEVVKAAQGRVPVFLDGGVRRGTDVFKALALGASGIFIGRPVVFSLAAEGEAGVRKVLSMLRDEFELTMALSGCRSLKEITRDHIVTEWDSPHPRPAPRL

SEQ ID NO: 2832 - protein, 372 aa, Vigna unguiculata
MGEITNVSEYEAIAKQKLPKMVFDYYASGAEDQWTLQENRNAFSRILFRPRILIDVSKIDMTTTVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKADDSGLASYVAGQIDRTLSWQDVKWLQTITTLPILVKGVLTAEDTRIAVQSGAAGIIVSNHGARQLDYVPATISALEEVVKAAEGRLPVFLDGGVRRGTDVFKALALGASGIFIGRPVVFSLAAEGEAGVRKVLQMLREEFELTMALSGCRSLKEITRDHIVTDWDQPRVQPRVRALL

SEQ ID NO: 2833 - protein, 367 aa, Zea mays
MELITNVTEYEKLAKERLPKMVYDYYASGAEDQWTLKENREAFSRILFRPRVLIDVSRIDMATNILGFSISMPIMIAPSAMQKMAHPDGELATARAAASAGTIMTLSSWSTSSVEEVNSVGPGIRFFQLYVYKDRNIVRQLVKRAEMAGFKAIALTVDTPILGRREADIKNRFALPPHLVLKNFQALDLGTMDKTNDSGLASYVAGQVDRTLSWKDVKWLQTITSLPILVKGIVTAEDTRLAIEYGAAGIIVSNHGARQLDYVPATISCLEEVAREAKGRLPVFLDGGVRRGTDVFKALALGASGVFIGRPVLFSLAVDGEAGVRKVLQMLRDELELTMALSGCTSLREITRAHVITDSDRIGRSRL

SEQ ID NO: 2834 - protein, 367 aa, Elaeis guineensis
  misc_feature (127)..(127): Xaa can be any naturally occurring amino acid
  misc_feature (140)..(140): Xaa can be any naturally occurring amino acid
MEITNVMEYQPIAKQKLPKMVYDYYASGAEDEWTLKENREAFSRILFRPRILIDVSRIDMTTTVLGFKISMPIMIAPTAMQKMAHPEGEYATARAASAAGTIMTLSSWATSSVEEVASTGPGIRFFXLYVYKDRNVVAQXVRRAERAGFKAIALTVDTPRLGRREADIKNRFTLPPFLTLKNFEGLDLGKMDKTSDSGLASYVAGQIDRSLSWKDVKWLQTITTMPILVKGVLTAEDTRLAIQNGAAGIIVSNHGARQLDYVPATITALEEVVKAAQGRIPVFLDGGVRRGTDVFKALALGASGVFIGRPVVFSLAAEGEAGVRKVLQMLRDEFELTMALSGCTSLKEITRSHIVTDADRHRPVSRL

SEQ ID NO: 2835 - protein, 368 aa, Carica papaya
MEEITNVMEYEVIAKQKLPKMVYDYYASGAEDQWTLNENRNAFSRILFRPRILIDVSNIDISTVVLGFKISMPIMIAPTAMQKMAHPDGEFATARAASAAGTIMTLSSWGTSSVEEVASTGPGIRFFQLYVLKDRNVVIQLVRRAEKAGFKAIVLTVDTPRLGRREADIKNRFVLPPHLILKNFEGLDLGKIDRTNDSGLASYVASQVDRSLSWKDLKWLQTITHLPILVKGVLTAEDARLAVEAGAAGIIVSNHGARQLDYVPATIMALEEVVKAAQGRIPVFLDGGVRRGTDVFKALALGASGVFIGRPVVFSLAAAGEAGVRKVLQMLHDEFELTMTLSGCRSLKEITRNHILTDWDRPRTASRL

SEQ ID NO: 2836 - protein, 368 aa, Raphanus sativus
MEITNVMEYEKIAKEKLPKMVYDYYASGAEDQWTLQENRNAFSRILFRPRILIDVSKIDVSTTVLGFNISMPIMVAPTAMQKMAHPDGELATARATSAAGTIMTLSSWATSSVEEVASTGPGIRFFQLYVYKDRNVVRQLVKRAEEAGFKAIALTVDTPRLGRRESDIKNRFALPRGLTLKNFEGLDLGKIDKTDDSGLASYVAGQVDQSLSWKDIKWLQSITSLPILVKGVITAEDARIAVEYGAAGIIVSNHGARQLDYVPATIMALEEVVKAVEGRLPVFLDGGVRRGTDVFKALALGASGVFVGRPSLFSLAANGEAGVRKMLQMLRDEFELTMALSGCRSLREISRNHIKTDWDFPHYLPAKL

SEQ ID NO: 2837 - protein, 367 aa, Oryza sativa
MELITNVSEYEQLAKQKLPKMIYDYYASGAEDQWTLKENREAFSRILFRPRILIDVSRINMATNVLGFNISMPIMIAPSAMQKMAHPEGELATARAASAAGTIMTLSSWSTSSVEEVNSAAPGIRFFQLYVYKDRNIVRQLVRRAELAGFKAIALTVDTPRLGRREADIKNRFNLPPHLVLKNFEALDLGKMDKTNDSGLASYVASQVDRSLSWTDVKWLQTITSLPILVKGVMTAEDTRLAVESGAAGIIVSNHGARQLDYVPATISCLEEVVREAKGRLPVFLDGGVRRGTDVFKALALGASGVFIGRPVLFSLAVDGEAGVRKVLQMLRDELELTMALSGCTSLAEITRNHVITDSDRIRRSRL

SEQ ID NO: 2838 - protein, 367 aa, Sorghum bicolor
MELITNVTEYEKLAKEKLPKMVYDYYASGAEDQWTLKENREAFSRILFRPRVLIDVSRIDMATNVLGFNISMPIMIAPSAMQKMAHPDGELATARAAASAGTIMTLSSWSTSSVDEVNSVGPGIRFFQLYVYKDRNIVRQLVKRAEMAGFKAIALTVDTPILGRREADIKNRFTLPPHLTLKNFEALDLGTMDKTNDSGLASYVAGQVDRTLSWKDIKWLQTITSLPILVKGVVTAEDTRLAIEYGAAGIIVSNHGARQLDYVPATISCLEEVVREAKGRLPVFLDGGVRRGTDVFKALALGASGVFIGRPVLFSLAVDGEAGVRKVLQMLRDELELTMALSGCTSLREITRAHVITDSDRIGRSRL

SEQ ID NO: 2839 - protein, 368 aa, Glycine max
MEMITNVTEYEAIAKEKLPKMVYDYYASGAEDQWTLKENRNAFSRILFRPRILVDVSKIDLTATVLGFKISMPIMIAPTAMQKMAHPEGELATARAASAAGTIMTLSSWATSSVEEVASTGPDIRFFQLYVFKDRNVVAQLVRRAERAGFKAIALTVDTPILGRREADIKNRFTLPPNLVLKNFEGLDLGKLDKTSDSGLASYVAGQIDRSLNWKDIKWLQSITSLPILVKGVLTAEDTRLAIQAGAAGIIVSNHGARQLDYVPATIMALEEVVKAAQGKIPVFLDGGIRRGTDVFKALALGAAGVFIGRPVVFSLAADGETGVRKVLQMLRDEFELTMALSGCRSLKEITRDHVVTEWDHPRFSPKL

SEQ ID NO: 2840 - protein, 367 aa, Saccharum officinarum
  misc_feature (305)..(305): Xaa can be any naturally occurring amino acid
  misc_feature (332)..(332): Xaa can be any naturally occurring amino acid
  misc_feature (336)..(336): Xaa can be any naturally occurring amino acid
  misc_feature (348)..(348): Xaa can be any naturally occurring amino acid
MELITNVTEYEKLAKEKLPKMVYDYYASGAEDQWTLKENREAFSRILFRPRILIDVSHIDMATNVLGFNISMPIMIAPSAMQKMAHPDGELATARAAASAGTIMTLSSWSTSSVEEVNSVGPGIRFFQLYVYKDRNIVRQLVKRAELAGFKAIALTVDTPILGRREADIKNRFTLPPHLTLKNFEALDLGTMDKTNDSGLASYVAGQVDRTLSWKDIKWLQTITSLPILVKGVVTAEDTRLAIEYGAAGIIVSNHGARQLDYVPATISCLEEVVREAKGRLPVFLDGGVRRGTDVFKALALGASXVFIGRPVLFSLAVDGEAGVRKVLQMLXDELXLTMALSGCTSLXEITRAHVITDSDRIRRSRL

SEQ ID NO: 2841 - protein, 369 aa, Helianthus annuus
MEVTNVTEYQAIAKEKLPKMVYDYYASGAEDQWTLEENRNAFSRILFRPRILIDVSKIDMTTTILGFKISMPIMLAPTAMQKMAHPEGEYATARAASSAGTIMTLSSWATSSVEEVASTGPGIRFFQLYVYKDRNVVAQLVRRAERAGFKAIALTVDTPRLGRREADIKNRFTLPPFLTLKNFEGLDLGKMDEANDSGLASYVAGQIDRTLSWKDVKWLQTITTMPILVKGVITAEDTRLAIQAGAAGIIVSNHGARQLDYVPATIMALEEVVKAAQGRVPVFLDGGVRRGTDVFKALALGASGIFIGRPVVFSLAAEGEAGVRKVLQMLRDEFELTMALSGCTSLSEITRDHIVTEWDAPRARPAPRL

SEQ ID NO: 2842 - protein, 367 aa, Panicum virgatum
MELITNVTEYEKLAKEKLPKMVYDYYASGAEDQWTLKENREAFSRILFRPRILIDVSHIDMATNILGFNISMPIMIAPSAMQKMAHPEGELATARAAASAGTIMTLSSWSTSSVEEVNSVGPGIRFFQLYVYKDRNIVRQLVKRAEMAGFKAIALTVDTPRLGRREADIKNRFTLPPHLVLKNFEDLDLGTMDKTNDSGLASYVAGQVDRTLSWKDVKWLQTITSLPILVKGVVTAEDTRLAIEYGAAGIIVSNHGARQLDYVPATISCLEEVVREAKGRLPVFLDGGVRRGTDVFKALALGASGVFIGRPVLFSLAVDGEAGVRKVLQMLRDELELTMALSGCTSLREITRAHVITDGDRIGRSRL

SEQ ID NO: 2843 - protein, 367 aa, Triticum aestivum
MEMITNVSEYERLAKEKLPKMVYDYYASGAEDQWTLNENREAFSRILFRPRVLIDVTHINMATNILGFDVSMPIMIAPTAMQKMAHPEGELATARAAASAGTIMTLSSWATSSVERVNSVGPGIRFFQLYVYKDRNIVRQLVKRAEMAGFKAIALTVDTPRLGRREADIKNRFNLPPHLVLENFAALDLGKMDKTDDSGLASYVASQVDQSLCWEDVRWLQTITSLPILVKGVMTAEDTRIAIEYGAAGIIVSNHGARQLDYVPATISCLEEVVREAKGRLPVFLDGGVRRGTDVFKALALGAAGVFIGRPVLYSLAVDGEAGVRKVLQMLRDELELAMALSGCPSLRDITRAHVVTDGDRIRRARL

SEQ ID NO: 2844 - protein, 323 aa, Triticum aestivum
RILFRPRVLIDVTHINMATNILGFDVSMPIMIAPTAMQKMAHPEGELATARAAASAGTIMTLSSWATSSVERVNSVGPGIRFFQLYVYKDRNIVRQLVKRAEMAGFKAIALTVDTPRLGRREADIKNRFILPPHLVLENFAALDLGKMDKTDDSGLASYVASQVDQSLCWEDVKWLQTITSLPILVKGVMTAEDTRIAIEYGAAGIIVSNHGARQLDYVPATISCLEEVVREAKGRLPVFLDGGVRRGTDVFKALALGAAGVFIGRPVLYSLAVDGEAGVRKVLQMLRDELELAMALSGCPSLRDITRAHVVTDGDRIRRARL

SEQ ID NO: 2845 - protein, 596 aa, Oryza sativa
MGFSKHKHLDGRMKHKLLKGYSLYTVSQGFVAILDVSRKKIPGSDGILGEKSGSRSKSKNVSTKSKEKLKGVFSLVQLKNETRKNKELHTQRRYQLKDLSWRSKDTTIDKKENQEVEHEENPKSCELEYGIYCLWSVEYKEVMKDFIVKRLKDQLFMARAHYPSIAKLKNQETFTRELKQNIQEHERMLSDTIADADLPPFFAKKLEKMEHTIERAKSCEVGCTSVERKLRQLLDITEDEAYFHTRQSAFLYHLGVQTMPKTHHCLNMRLTVEYFKSTSIHTVQSNKQKLEDPTFHHYVIFSKNVLAVSTTINSTVMNSKDSGSIVFHLFTDSQNFYAMKHWFDRNMYLEATVHVTDIEDHQKLSKDVDFHDMKLLRPAEEFRVTFRNHSQSFQKQMKTEYISTFGHSHFLLPDLLPSLNRVVVLDDDLIVQKDLSSLWNLNMGGKVVGAIQFCEVKLGQLKAYTEERNFDNNSCVWLSGLNVVELKKWRDLHITSRYEQLLQKLQKDSVTSFPLKVLPISLLVFQDLIYPLEDSWVQSGLGHDYGVSQTDIKRSVTLHYNGVMKPWLDLGIHDYKGYWRKYMTNGERFMTECNIH

SEQ ID NO: 2846 - protein, 216 aa, Hordeum vulgare
MSKEQQHRHEHHLRRCCGGLAACLLFLVVAVALTALIVYLALRPAKPSFYLQDLQLRSVSFGDPSLSATAQVTLASRNPNDRVGVLYRRLDVFVTYRDEPVTVPVSLSPAYQGHRDVTIWSPVLSGESVPVAGFVADAMRQDIAAGYVALQVKVDGRVRWKVGSWVSGSYHLFVSCPAVLAAGPGGMPLGGGPNGTSGRAVAALKFAQPTGCTVGT

SEQ ID NO: 2847 - protein, 218 aa, Brachypodium distachyon
MKEKHHKHEHRLRRCCGGFAACLLALVLIVAFTALVVYLALRPTKPTFFLQDLQLRSIHLGDPSLSATAQVTLASRNPNDRVGVFYRRLDVFVTYRDEPVTVPVSLPPMYQGHRDVTIWSPVLSGESVPVAGYVADAMRQDIAAGYVVLQVKVDGRVKWKVGSWVSGSYHLFVSCPAVLAAGPGGMSTSLAGSAGGLNGSLSVASLKFTQPTGCTVGT

SEQ ID NO: 2848 - protein, 215 aa, Leymus cinereus x Leymus triticoides
MSKEKHHRHEHHLRRCCGGFAACLLALVVVVAFIALVVYLALRPTKPSFYLQDLQLRSINLGDPSLSATAQVTLASRNPNDHVGIFYRRLDVFVTYRDEPVTVPVSLPPMYQGHRDVTIWSPVLSGESVPVAGYVAEAMKQDIAAGYVSLQVKIDGRVKWKVGTWVSGSYHLFVSCPAMLAAGPGGMPLGGGPNGTGGAVASLKFTQPTGCPVGT

SEQ ID NO: 2849 - protein, 215 aa, Pseudoroegneria spicata
  misc_feature (212)..(212): Xaa can be any naturally occurring amino acid
MSKEKHHRHEHHLRRCCGGFAACLLALVVIVAFIALVVYLALRPTKPSFYLQDLQLRSINLGDPSLSATAQVTLASRNPNDRVGIFYRRLDVFVTYRDEPVTVPVSLPPMYQGHRDVTIWSPVLSGESVPVAGYVAEAMKQDIASGYVSLLVKVDGRVKWKVGSWVSGSYHLFVSCPAMLAAGPGGMPLGGGPNGTGGAVASLKFTQPTGCXVGT

SEQ ID NO: 2850 - protein, 224 aa, Oryza sativa
MSKEKHHKREHHLRRCCGGMAACILALVLVVGFIALVVYLALRPSKPSFYLQDLQLRSVDLGDPSLSATAQVTLASRNPNDHVGVHYRRLDVFVTYRDEPVTVPVSLPPTYQGHRDVTIWSPVLSGESVPVAGFVADALRQDVAAGYVALQVKVDGRVKWKVGSWVSGSYHLFVSCPAMLASAGPGGVGPMPLGGASAAVVNGTGAGAVASLRFTQPTGCSVEV

SEQ ID NO: 2851 - protein, 215 aa, Triticum aestivum
  misc_feature (8)..(9): Xaa can be any naturally occurring amino acid
  misc_feature (11)..(12): Xaa can be any naturally occurring amino acid
  misc_feature (18)..(18): Xaa can be any naturally occurring amino acid
MNKEKHHXXEXXLRRCCXGFAACLLALVVVVAFIALVVYLALRPTKPSFYLQDLQLHSINLGDPSLSATAQVTLASRNPNDRVGIFYRRLDVFVTYRDEPVTVPISLPPMYQGHRDVTIWSPVLSGESVPVAGYVAEAMKQDIASGYVSLQVKIDGRVKWKVGTWVSGSYHLFVSCPAMLAAGPGGMPLGGGPNGTGGAVASLKFTQPTGCTVGT

SEQ ID NO: 2852 - protein, 214 aa, Triticum aestivum
  misc_feature (166)..(166): Xaa can be any naturally occurring amino acid
  misc_feature (174)..(174): Xaa can be any naturally occurring amino acid
  misc_feature (178)..(178): Xaa can be any naturally occurring amino acid
  misc_feature (196)..(196): Xaa can be any naturally occurring amino acid
  misc_feature (202)..(203): Xaa can be any naturally occurring amino acid
  misc_feature (205)..(205): Xaa can be any naturally occurring amino acid
  misc_feature (210)..(210): Xaa can be any naturally occurring amino acid
MSKDRHEHHLRRCCGGLAACLLFLVVAVAVTALVVYLVLRPAKPSFYLQDLQLRSVSLGDPSLSATAQVTLASRNPNDRVGVLYRRLDVFVTYRDEPVTVPVSLPPAYQGHRDVTIWSPVLSGESVPVAGFVADAMKQDIAAGYVALQVKVDGRVRWKVGSWVSGXYHLFVSCXAVLXAGPGGMPTGGAGLNGTAXRAVASXXFXQPTGXTVGT

SEQ ID NO: 2853 - protein, 1234 aa, Brachypodium distachyon
MATPMAGEGPIATAIPRSPPPPAASAAAAAGGAGSAAEAPVLIFVYFHKAIRAELERLHAAAVRLATERGGDVAALERRCRFLFSVYRHHCDAEDAVIFPALDIRVKNVAGTYSLEHKRENDLFAHLFALFQLDVHNNDGLRRELASCAGAIRTIISQHMFKEEEQVFPLLITKFSHEEQAGLVWQFLCNIPINMMADFLPWLSSSVSPDEHQDIIDCLHEIVPQEKLLQQIVFGWFGGKAVRTEEDFDNPCSKGSCRCENNSYQTDKHGCSHAHCKIGKRKYAESSRSLLAIHPIDEILCWHNAIRTELRDIVDETRRIQQFGDFSNIPAFNLRLQFIADVCIFHSIAEDQVIFPAVDGEVSFEKEHAEQEQRFNKFRCLIEQIQTAGARSTVVDFYTELCSQADQIMEEIEEHFNNEETKVLPQARIKFSPEKQSELLYKSLCIMPLKLLEHVLPWFVSKLDDANAQSFLQNMCSAAPSSETALVTLLSGWACKGRLKDTSNSGKFLCLTSGALNCSYDGDELNERQSFCPCSVSNNGAFSPPQLTANGSRPVKRGNHAESSTDIKRSHCSQTTDIEEAPCNNRPCHIPGLRAESTNVGADSLASANSFRSLCYSYSAPSLYSSLFSWETDAAFSSPDNISRPIDAIFKFHKAIRKDLEFLDVESGKLIDGDKSCLRQFVGRFRLLWGLYRAHSNAEDEIVFPALESKETLHNVSHSYTLDHKQEEELFKDISTVLFDLSQLHDDSSHSIDETNEAGNHICSHNETYRSRKHNELVTKLQGMCKSIRVTLSNHVHREELELWPLFDKHFSVDDQDKIVGRIIGSTGAEVLQSMLPWVTSALSLEEQNSMLDTMKQATKNTMFDEWLNEWWTRSPSSSGPSNETSSSPEENHFQENLDHSDQMFKPGWKDIFRMNQSELEAEIRKVSQNSTLDPRRKAYLIQNLMTSRWIAAQQKSPQPKSEDHNGSTVIPGCFPSYRDGENQIFGCEHYKRNCKLVAACCNKLFTCRFCHDKVSDHTMERKATVEMMCMRCLKVQPVGSNCQTPSCNGLSMAKYHCSICKFFDDERSVYHCPFCNLCRVGQGLGTDFFHCMNCNCCLGVKLIEHKCREKMLEMNCPICCDFLFTSSAAVRGLPCGHFMHSACFQAYTCSHYTCPICSKSLGDMTVYFGMLDGLLAAEELPPEYRDRCQDILCNDCGRKGRSRFHWLYHKCGACGSYNTRVIKTDAADCSTSN

SEQ ID NO: 2854 - protein, 271 aa, Brachypodium distachyon
MSLLSKLRLVTVDVTGTLIAYKGRLGDYYCMAAKSAGKPCPDYNRMHEGFKLAYTEMARKYPCFGFAAKMPTIEWWRMCVKDSFVKAGYDYDDETFEKIFKRIYSAFGSSAPYSVFPDAQPFLRGLREKGITVGIVSNAEYRYKEVILPALGLNQGSEWDFGVFSGIVGVEKPDPAIYKIALEMAGNVAPEEALHIGDSMRKDYVPARSIGMHGLLLDRFKTADAESWKQSGAPVLPDLVAAEAWLAQNQKAETEEEPLAASLLRRMSEKL

SEQ ID NO: 2855 - protein, 158 aa, Leymus cinereus x Leymus triticoides
MLLLSKLRLVTVDVTGTLLAYKGRLGDYYCMAAKSAGKPCPDYDRMHEGFKLAYTEMARKYPCFGFAAKMPTIEWWRICVKDSFVKAGYDYDDETFEKVFKRIYSAFGSSAPYSVFPDAQPFMRGLREKGITVGIVSNAEYRYKEVILPALGLNQLCN

SEQ ID NO: 2856 - protein, 270 aa, Zea mays
MSLLSKLRLITVDVTGTLIAYKGHLGDYYCMAAKSAGMPCPDYNRMHEGFKLAYTEMARQYPCFGFAAKMPNIEWWRTCVKNSFVKAGYDYDEETFEKVFRRIYSAFGSSAPYSAFPDSQPFLRWAREKGLTVGIVSNAEYRYKDVILPALGLNQSSEWDFGVFSGVVGVEKPDPRIYKIALEMAGNVAPEEALHIGDSMRKDYTPARSIGMHALLLDRFKTADAESWRQSGATVLPDLVATQEWLTKDQNDEQEETVAARVLKRMSEKL

SEQ ID NO: 2857 - protein, 275 aa, Pennisetum glaucum
MSLLSKLRLITVDVTGTLIAYKGHLGDYYCMAAKSAGMPCPDYNRMHEGFKLAYTEMARQYPCFGFAAKMPNIEWWRTCVKNSFVKAGYDYDEETFEKIFRRIYSAFGSSAPYSAFPDAQPFLRWAREKGLTVGIVSNAEYRYKDVILPALGLNQGSEWDFGVFSGVVGIEKPDPRIYKLALEMAGNIAPEEALHIGDSMRKDYVPARSIGMRALLLDRFKTADAESWRQSGATVLPDLVATQEWLTKDQNEEPKHETVAAQVLNRMSEKLKMGA

SEQ ID NO: 2858 - protein, 261 aa, Oryza sativa
MSLISKLRLITVDVTGTLLAYKGQLGDYYCMAAKAAGKPCPDYQRMHEGFKLAYTEMARQYPCFGFAAKMPNIDWWRMCVKDSFVKAGYEYDEETFEKIFKRIYSSFGSSAPYSVFPDAQPFMRWLRGKGLTVGIVSNAEYRYKDVILPALGLNQGSEWDFGVFSGIVGVEKPDPSIYRIALEMAGKVAPEEALHIGDSMRKDYTPARSIGMHALLLDRFKTADAESWRKSGATVLPDLVAAQEWLSKNLKDEPVAAEQNV

SEQ ID NO: 2859 - protein, 274 aa, Sorghum bicolor
MSLLSKLRLITVDVTGTLIAYKGHLGDYYCMAAKSAGMPCPDYNRMHEGFKLAYTEMARQYPCFGFAAKMPNIEWWRTCVKNSFVKAGYDYDEETFEKIFRRIYSAFGSSAPYSAFPDAQPFMRWAREKGLIVGVVSNAEYRYKDVILPALGLNQGSEWDFGVFSGMVGVEKPDPRIYKIALEMAGNVAPEEALHIGDSMRKDYTPARSIGMHALLLDRFKTADAESWRQSGATVLPDLVATQEWLTKNQNEEQEKTVASRVLNRMSEKLKMGA

SEQ ID NO: 2860 - protein, 275 aa, Panicum virgatum
MSLLSKLRLITVDVTGTLIAYKGHLGDYYCMAAKSAGMPCPDYNRVHEGFKVAYTEMARQYPCFGFAAKMPNIEWWRTCVKNSFVKAGYDYDEETFEKIFRRIYSAFGSSAPYSAFPDALPFLRWARVKGLTVGIVSNAEYRYKDVILPALGLNQGSEWDFGVFSGIVGVEKPDPRIYKIALEMAGNIAPEEALHIGDSMRKDYTPARSVGMHALLLDRFKTADAESWRQSGATVLPDLVATQEWLTKNQNEEPKHETVAAQVLNRMSEKLKMGA

SEQ ID NO: 2861 - protein, 275 aa, Panicum virgatum
MSLLSKLRLITVDVTGTLIAYKGHLGDYYCMAAKSAGMPCPDYNRVHEGFKVAYTEMARQYPCFGFAAKMPNIEWWRTCVKNSFVKAGYDYDEETFEKIFRRIYSAFGSSAPYSAFPDAQPFLRWAREKGLIVGIVSNAEYRYKDVILPALGLNQGSEWDFGVFSGIAGVEKPDPRIYKIALEMAGNIAPEEALHIGDSMRKDYTPARSVGMHGLLLDRFKTADAESWRQSGATVLHDLVATQEWLTKNQNEEQKHETVAAQVLNRMSGKLKMGA

SEQ ID NO: 2862 - protein, 267 aa, Triticum aestivum
MSLLSKLRLVTVDVTGTLLAYKGRLGDYYCMAAKSAGKPCPDYDRMHEGFKLAYTEMARKYPCFGFAAKMPTIEWWRICVKDSFVKAGYDYDDETFDKVFKRIYSAFGSSAPYSVFPDAQPFMRGLREKGITVGIVSNAEYRYKEVILPALGLNQGSEWDFGVFSGIVGVEKPDPKIYKIALEMAGNVAPEEALHIGDSYRKDYVPARSIGMHALLLDRFKTADAESWRKSGAPVLPDLEAAQAWLTKNPTEEPLGAALLRRMAEKL

SEQ ID NO: 2863 - protein, 271 aa, Triticum aestivum
MSLLSKLRLVTVDVTGTLLAYKGRLGDYYCMAAKAAGKPCPDYDRMHEGFKLAYTEMARKYPCFGFAAKMPTIEWWRICVKDSFVKAGYDYDDETFDKVFKRIYSAFGSSAPYSVFPDAQPFMRGLREKGITVGIVSNAEYRYKEVILPALGLNQGSEWDFGVFSGIVGVEKPDPKIYKIALEMAGNVAPEEALHIGDSYRKDYVPARSIGMHALLLDRFKTADAESWRQSGAPVLPDLEAAQAWLTKNPTEEPAEEPLGAALLRRMAEKL

SEQ ID NO: 2864 - protein, 271 aa, Triticum aestivum
MSLLSKLRLVTVDVTGTLLAYKGRLGDYYCMAAKAAGKPCPDYDRMHEGFKLAYTEMARKYPCFGFAAKMPTIEWWRICVKDSFVKAGYDYDDETFEKVFKRIYSAFGSSAPYSVFPDAQPFMRGLREKGITVGIVSNAEYRYKEVILPALGLNQGSEWDFGVFSGIVGVEKPDPTIYKIALEMAGNVAPEEALHIGDSYRKDYVPARSIGMHALLLDRFKTAEAESWRKSGAPVLPDLEAAQAWLTKNPTEEPAEEPLGAALLRRMAEKL

SEQ ID NO: 2865 - protein, 304 aa, Brachypodium distachyon
MMHSKVICCKLYISESQNAMVVDAISRIGQKDPEVVLLSKFEDEYYNRVRYTLVSYIISNSSTGEVIFSPIRKVLLAMIEAAFSNINLEVHCGTHPRIGVVDDMSFHPLSQAATMEDAAQLAKLLASDIGNGLQVPVFLYAAAHPTGKSVSAIRRELGYYRPNHKGIKWAGQVLPDTLPMKPDEGPTQVPRERGATMVGAKPFVESYNVPILCKDVPTVRRITRRVTGRSGGFPTVQALALFHGDNCTEIACLLDPDHVGAEQVQWLVEQIAAEQGLEVDKGYFTDLSKDMMLERYFKMVSAAD

SEQ ID NO: 2866 - protein, 316 aa, Pseudoroegneria spicata
  misc_feature (51)..(51): Xaa can be any naturally occurring amino acid
  misc_feature (71)..(71): Xaa can be any naturally occurring amino acid
  misc_feature (75)..(75): Xaa can be any naturally occurring amino acid
  misc_feature (109)..(109): Xaa can be any naturally occurring amino acid
  misc_feature (116)..(116): Xaa can be any naturally occurring amino acid
  misc_feature (123)..(123): Xaa can be any naturally occurring amino acid
  misc_feature (172)..(172): Xaa can be any naturally occurring amino acid
  misc_feature (184)..(184): Xaa can be any naturally occurring amino acid
  misc_feature (192)..(192): Xaa can be any naturally occurring amino acid
  misc_feature (199)..(199): Xaa can be any naturally occurring amino acid
  misc_feature (203)..(204): Xaa can be any naturally occurring amino acid
  misc_feature (213)..(213): Xaa can be any naturally occurring amino acid
  misc_feature (215)..(215): Xaa can be any naturally occurring amino acid
  misc_feature (224)..(224): Xaa can be any naturally occurring amino acid
  misc_feature (275)..(275): Xaa can be any naturally occurring amino acid
  misc_feature (283)..(283): Xaa can be any naturally occurring amino acid
  misc_feature (302)..(302): Xaa can be any naturally occurring amino acid
  misc_feature (309)..(309): Xaa can be any naturally occurring amino acid
MEGKHTDQAKLSTMHSKVICCKLYISESQNAAVVDAISRIGQKDPEVVLLXKFEDEYYNRVRYTLVSYITXESSXGEAVFSPIRKVLLAMIEAAFSAINLEVHSGTHPXIGVVDDXSFHPLSXAATMEDAAQLAKLVASDIGNGLQVPVFLYAAAHPTSKSVSAVRRELGYXRPNHKGVQWAGXVLPDTLPXKPDVGPXHVSXXRGATMVGAXPXVESYNVPIXCKDVPTVRRITRRVTGRSGGFPTVQALALFHGDNCMEIACFLDPDHVGADXVQWLVEQXAEEQGLEVDKGYFTDLSKXMMLERYXEMVSAAD

SEQ ID NO: 2867 - protein, 321 aa, Triticum aestivum
MESKHTDQANVKAKLSTMHSKVICCKLYISESQNAAVVDAISRIGQKDPEVVLLNKFEDEYYNRVRYTLVSYITNESSTGGAVFSPIRKVLLAMIEAAFSAINLEVHCGTHPRIGVVDDISFHPLNQADTIEDAAQLAKLVASDIGNGLQVPVFLYAAAHPTSKSVSAVRRELGYFRPNHKGVQWAGPVLPDTLPMKPDVGPVHVPRERGATMVGAQPLVESYNVPIFCKDVPTVRRITRRVTGRSGGLPSVQALALFHGDNCTEIACFLLDPDHVGADRVQWLVEQIAEEQGLEVEKGYFTDLSKHMMLERYSEMVSAAD

SEQ ID NO: 2868 - protein, 321 aa, Triticum aestivum
  misc_feature (7)..(7): Xaa can be any naturally occurring amino acid
IELKTWXGKRTDQAKLSTMHPKVICCKLYISESQNAAVVDAISRIGQKDPEVVLLSKFEDEYYNRVRYTLASYITSESSTGEAVFSPIRKVLLAMIEAAFSAINLEVHSGTHPRIGVVDDMSVHPLSQEATMEDAAQLAKLVASDIGNGLQVPVFLYAAAHPTSKSVSAIRRELGYYRPNHKGVQWAGQVLPDTLPVKPDVGPAHVSSKRGATMVGAKPFVESYNVPIFCKDVPTVRRITRRVTGRSGGFPTVQALALFHGDNCTEIACLLDPDHVGADQVQWLVEQIAGEQGLEVDKGYFTDLSKDMMLERYFKMVSAAD

SEQ ID NO: 2869 - protein, 343 aa, Triticum aestivum
SARGLGLTRNKRFLASNFLIHITIRRRRCSTTPFHSPQARERESDRGGAEGMEGKHTEQANVKAKLSTMHLKVICCKLYISESQNAAVVDAISRIGQKDPEVGLLSKFEDEYYNRVRYTLVSYITSESSTGEAVFSPIRKVLLAMIEAAFSAINLEVHCGTHPRIGVVDDMSFHPLSQAATMEDAAQLAKLVASDIGNGLQVPVFLYAAAHPTSKSVSAVRRELGYYRPNHNGIQWTGQVLPDTLPVKPDVGPAHVSSKRGATMVGAKPFVESYNVPIFCKDVPTVRRITRRVTGRSGGFPTVQALALFHGDNCTEIACAGSRPCWCRSGSVAGGADCRRARA

SEQ ID NO: 2870 - protein, 119 aa, arabidopsis lyrata
MGVFTFVCKNGGGAWTAKQHEGELEASASSTYELQRKLVQAALSADSSGGVQSSFSLVSPTSAVFQVIVGGGGGGGFAAGGAASGGGGAGESAAAPKEDEKKKEESEEEEGDFGFDLFG

SEQ ID NO: 2871 - protein, 120 aa, arabidopsis lyrata
MGVFTFVCKSKGGEWTAKQHEGDLEASASSTYDLQRKLVQTALSADSSGGVQSSFSLVSPTSAVFQVIIGGGGGGGFAAGGGAAAGGGGGGESAAATKEEEKKKEESEEEEGDFGFDLFG

SEQ ID NO: 2872 - protein, 66 aa, Arabidopsis thaliana
MGVFTFVCKNGGGAWSASNTKENLNLQLLLPTSSSVSSFRYLSPLIPPVAFSLRFLLSPLPPPYSR

SEQ ID NO: 2873 - protein, 120 aa, Brassica oleracea
MGVFTFVCKSKGGEWSAKQHEGDLEASASSTYDLQRKVVQTALSADSSGGVQSSFSLVSPTSAVFQVIIGGGSGGGFAAGGGAAAGGGGGGEAAAATKEEEKKKEESEEEEGDFGFDLFG

SEQ ID NO: 2874 - protein, 121 aa, Brassica oleracea
MGVFTFVCKSKGGEWTAKQHEGDLEASASSTYDLQRKLVQTALSADSSGGVQSSFSLVSPASAVFQVIIGGGSGGGFAAGGGAAAGGGGGGGESAAAAKEEEKKKEESEEEEGDFGFDLFG

SEQ ID NO: 2875 - protein, 524 aa, Brassica rapa
MALHKFPLMGLLLLLTIVVSPATADGPVCPPTTKLSRASFPEGFLFGTATAAYQVEGAVNETCRGPSLWDIYCKRFPSRCNYDNGDVAVDFFHRYKEDIQLMKNLNTDAFRMSIAWPRIFPHGRKEKGVSQAGVQFYHDLIDELKRNGITPFVTVFHWDTPQDLEDEYGGFLSERIVKDFREYADFVFQEYGGKVKHWITFNEPWVFSHAGYDVGKKAPGRCSKYVKEECQEGRSGFEAYLVTHNLLNSHAEAVEAFRQCEKCKGGKIGIAHSPAWFEPHDLADSQDGASIDRALDFILGWHLDTTMYGDYPQIMKDIVGHRLPKFTDAQKAKLKNSADFVGLNYYTSVFSNHLEKPDPSKPRWMQDSLINWETKNAYNYSIGSKPITGALPVFARGFRSLLKYIKDKYGNPEIMIMENGYGEELGATDSVAVGTADHNRKYYLQRHLLSMNEAICIDKVNVTGYFVWSLLDNFEWQDGYKNRFGLYYIDFKNNLTRYEKESGKYYKEFLSQGVRPSMINRDEL

SEQ ID NO: 2876 - protein, 121 aa, Brassica rapa
MGVFTFVCKSKGGEWTAKQHEGDLEASDSSTYDLQRKLVQTALSADSSGGVQSSFSLVSPTSAVFQVIIGGGSGGGFAAGGGAAAGGASGGGESAAAAKEEEKKKEESEEEEGDFGFDLFG

SEQ ID NO: 2877 - protein, 120 aa, Brassica rapa
MGVFTFVCKSKGGEWTAKQHEGDLEGSASSTYDLQRKLVQTALSADSSGGVQSSFSLVSPSSAVFQVIIGGGSGGGFAAGGGAAAGGGGGGEAAAATKEEEKKKEESEEEEGDFGFDLFG

SEQ ID NO: 2878 - protein, 121 aa, Brassica napus
MGVFTFVCKSKGGEWTAKQHEGDLEASASSTYDLQRKLVQTALSADSSGGVQSSFSLVSPTSAVFQVIIGGGSGGGFAAGGGAAAGGGGSGGESAAAAKEEEKKKEESEEEEGDFGFDLFG

SEQ ID NO: 2879 - protein, 120 aa, Brassica napus; identical to SEQ ID NO: 2877

SEQ ID NO: 2880 - protein, 120 aa, Brassica napus; identical to SEQ ID NO: 2873

SEQ ID NO: 2881 - protein, 121 aa, Brassica napus; identical to SEQ ID NO: 2876

SEQ ID NO: 2882 - protein, 120 aa, Raphanus sativus
MGVFTFVCKSKGGEWTAKQYEGDLEASASSTYDLQRKLVQAALSADSSGGVQSSFSLVCPTSAVCQVTIGGGSGGGFAAGGGAAAGGGGGGEAAAAAKEEEKKKEESEEEEGDFGFDLFG

SEQ ID NO: 2883 - protein, 120 aa, Raphanus sativus
MGVFTFVCKSKGGEWTAKQHEGDLEASASSTYDLQRKLVQAALSADSSGGVQSSFSLVCPTSAVCQVIIGGGSGGGFAAGGGAAAGGGGGGESAAAAKEEEKKKEESEEEEGDFGFDLFG

SEQ ID NO: 2884 - protein, 121 aa, Thellungiella halophila
MGVYTFVCKSKGGEWTAKQHEGDLEASASSTYDLQRKLVQTALSTDSSGGVTSSFSLVSPTSAVCQVIIGGAVGGGFAAGGGAAAGGGGGAGEAAAATKEEEKKKEESEEEEGDFGFDLFG

SEQ ID NO: 2885 - protein, 65 aa, Hordeum vulgare
MEIRPMVALRAALVGGVAAFAKIAGAMKAAGGVKVGAAAAAMTAAATAAVSGKDAGNDNQKPGAK

SEQ ID NO: 2886 - protein, 65 aa, Brachypodium distachyon
MEIRPMVALRAALVGGVAAFAKIAGAMKAAGSMKVGAAAAAMTAAATAAVSGKDTNKENQKPGAQ

SEQ ID NO: 2887 - protein, 65 aa, Cenchrus ciliaris
MEVRPMVALRAALVGGIPAFAKIGGAMKGAGEIKIGAAAAAVTAAASAAISGKDTSKDNPKAETK

SEQ ID NO: 2888 - protein, 65 aa, Pennisetum glaucum
MEVRPMVALRAALVGGIAAFAKIGGAMKAAGGVKIGAAAAAVTAAASAAISGKDTSKDTPKAETK

SEQ ID NO: 2889 - protein, 65 aa, Sorghum bicolor
MEVRPMVALRAALVGGVAAFAKIGGAMKAAGGVKIGAAAAAVTAAASAAVSGKDAKEDASKAETK

SEQ ID NO: 2890 - protein, 65 aa, Panicum virgatum
MEVRPMVALRAALVGGIAAFAKIGGAMKAAGGVKIGAAAAAVTAAASAAVSGKDTSKDPSKAETK

SEQ ID NO: 2891 - protein, 78 aa, Triticum aestivum
  misc_feature (47)..(49): Xaa can be any naturally occurring amino acid
RVRNNTMEVRPMVALRAALVGGVAAFAKIGAAMKAAGGAKVGAAAAXXXGQLQQQLLYLAKTQTKIIRRLKQNDMCLT

SEQ ID NO: 2892 - protein, 129 aa, Triticum aestivum
  misc_feature (109)..(109): Xaa can be any naturally occurring amino acid
ASHTAAAAPCLSASHRRPFSPLPTPHPTPLVLAPIAAPGCPHRRIAFPPSPPLPQSLGPEEHTMEIRPMVALRAALVGGVAAFAKIAGAMKAAGGVKVGAAAAAMTAAXTAAVSGKDAGNDNQKPGATK

SEQ ID NO: 2893 - protein, 306 aa, Hordeum vulgare
MIRAMQVVVRGEIRRAAVAGAGFVGHCGYSTVITSSQRLAGKVAVITGGASGIGKATAAEFVRNGAKVILADVQDDLGRAVAAELGPNAACYARCDVTDEAQVAAAVDLAVARHGKLDIMLNNAGIMGSLARPRLSDLDLADFDAVMAINARGVLAGVKHAARVMAPRRSGSIICMASVAGVLGSVTPHPYSVSKAAVLGVVRAVAGEMARSGVRVNAISPNYIPTPLVMRILEQWYPKASAEEHRRIVEEDINEMEGAVLEPDDIARAALYLASDEAKYVNGHNLVVDGGFTVGKAPNMPPAPAL

SEQ ID NO: 2894 - protein, 305 aa, Hordeum vulgare
MIRAMQVVVSGESRRAAVAGFGFVGHCGYSMASSSQRLAGKVAVITGGASGIGKAMAAEFVRNGAKVVLADVQDDLGRAAAAELGPNAACYACCDVTDEAQVVAAVDLVVARHGKLDIMLNNVGIVGSLARPRLSDLDLADFDAIMAINARGVLAGMKHSARVMAPRRSGSIICMASVAGVLGSVTPHPYSVSKAAALGVVRAVAGEMARSGVRVNAISPNYIPTPLVMRILERWYLKASAEEHRRIVEGDINEMEGAVLEPDDIARVALYLASDEAKYVNGHNLVVDSRFSVGKAPNMPSAPAL

SEQ ID NO: 2895 - protein, 296 aa, Pseudoroegneria spicata
RGESRRAALASVAGYVSHCGYSTASSSQRLAGKVAVITGGASGIGKATAAEFVRNGAKVVLADVQDDLGRAVAAELGPDAACYTRCDVTDEAQVAAAVDLAVARHGKLDIMLNNAGIVGSLARPRLSDLDLADFDAVMAINARGVLAGVKHAARVMAPRRSGSIICMASVAGVLGSVTPHPYSVSKAAVLGIVRAVAGEMARSGVRVNAISPNYIPTPLVMRILEQWYPKASAEEHRRIVEGDINEMEGAVLEPDDIARAALYLASDEAKYVNGHNLVVDGGFTVGKAPNMPAPAL

SEQ ID NO: 2896 - protein, 305 aa, Pseudoroegneria spicata
MFRAMQVVLRGESRRAASAAGAGLAGHCGYSTASSAQRLAGKVAVITGAASGIGKATAAEFIRNGAKVVLADVQDDLGCALAAELGADSASYTRCDVTDEAQVAAVVDLAVARHGKLDIMLNNAGIVGSLARPELGALELADFDAVMAINTRGVMAGVKHAARVMAPRRAGSIICTASIAGVLGSVTPHPYSVSKAAVVGLVRAVAGELARSGVRVNAISPNYIPTPLVMRILQEWYPKASAEEHRRIVEGDINEMEGVVLEVEDIAKAALYLASDESKYVNGHNLVVDGGFTVGKVPNMPAPAQ

SEQ ID NO: 2897 - protein, 296 aa, Oryza sativa
MFRALQIVLRGKSRGFVSHFSSTASNSERLAGKVAVITGAASGIGKATAAEFVRNGAKVILADVQDDVGRAVASELGADAASYTRCDVTDEAQVAAAVDLAVARHGQLDVMVNNAGIVGSLSRPPLGALDLADFDAVMAVNTRGVLAGVKHAARVMAPRRRGSIICVASVAGVLGSVTPHPYSVSKAAVLGAVRAAAGEMARSGVRVNAISPNYIPTPLVMRIMAEWYPGASADEHRRVVEREINEMEGATLEPEDIARAAVYLASDEAKYVNGHNLVVDGGYTVGKAPNLPAPPQ

SEQ ID NO: 2898 - protein, 305 aa, Triticum aestivum
  misc_feature (99)..(99): Xaa can be any naturally occurring amino acid
  misc_feature (141)..(141): Xaa can be any naturally occurring amino acid
  misc_feature (205)..(205): Xaa can be any naturally occurring amino acid
MIRAVQVVTSVESRRAARASVAGYASRCGYSTASSSQRLAGKVAVITGGASGIGKATAEEFVRNGAKVVLADVQDDLGRAVAAELGPDAACYTHCDVTXEAQVAAAVDLAVARHGKLDIMLNNAGIVGSLARPRLSDLDLXDFDAVMAINARGVMAGVKHAARVMAPRRSGSIICMASVAGVLGSVTPHPYSVSKAAVLGIVRAXAGEMARSGVRVNAVSPNYIPTPLVMRILEQWYPKASAEEHRRIVEGDINEMEGAVLEPDDIARAALYLASDEAKYVNGHNLVVDGGFTVGKAPNMPAPAL

SEQ ID NO: 2899 - protein, 118 aa, Hordeum vulgare
MAAVRCAARRLGGALLQRTQAEEGRLLAPSRLMRSRHLSTKVSGEARNIQKKGDDIWAGFKETLKRVSERPPEKKPNVLLQRMMLIEQVTKSVVYGAFKLTVVYAAAAAAFGGRWLEN

SEQ ID NO: 2900 - protein, 113 aa, Triticum aestivum
  misc_feature (113)..(113): Xaa can be any naturally occurring amino acid
VHPNKACQTSPSSVVPIPTTSSLHRLLQLSRAEGKGLMEGLIPFIYRAVAQYRKEGQVSLADLLFDEQPSSSPTAASAYFRLPGDSGRHQRVSADSGAPSAHHGARIVVTDCX

SEQ ID NO: 2901 - protein, 81 aa, Triticum aestivum
MEGLIPFIYRAVAQYRKEGQVSLADLLFDEQPSSSPTAASAYFRLAGDSGRHQLFSADSGAAGAARRSPPHRRRTMEHGSW

SEQ ID NO: 2902 - protein, 81 aa, Triticum aestivum
MEGLIPFIYRAVAQYRKEGQVSLADLLFDEQPSSSPTAASAYFRLPGDSGRHQRFSGDSGAAGAARRSPAHRRRSMEHGSW

SEQ ID NO: 2903 - protein, 272 aa, Triticum aestivum
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKQPKPQLKEEDHEDEAPDAGEDGGGAAGGGGGGEEHGDTLCGACGDNYGQDEFWIGCDMCEKWFHGKCVKITPAKAEHIKQYKCPSCMGANGGGSGSNKRARPSS

SEQ ID NO: 2904 - protein, 125 aa, Triticum aestivum
RRDQTMAANHHLRRLASASAPALSRLSKPTPSPLLRPAFSSSASPAGQPAAAAGADAAEKGEARSAVKEAGEAQGGDAGARKTGEEEEDDGGLDINEATGEIGGPHGPEPTRYGDWERGGRCSDF

SEQ ID NO: 2905 - protein, 635 aa, Brachypodium distachyon
MSNYYSSPGNERDSQTMYSPDSGSASYPVSSAALGNLIYSNNASSGPYTEFNGIIQSHQNFMELSGHPSEISHHSSSTEPNMVTSLTDQHSFGPAKDMRNEMLTHFMDGAHSTGGDLLHNDTHNGAQLEFGLLNSHNSTSVPSAPGQGLSLGLHTHILAPSYPYWSMKPDLMAAQSYQGDHNITKDMQSEASRAIRNSKYLKAAQELLDEIVSVWKIIKQNAQKDQVETGKVDGKEAHGVSKSEGLSSNPQETTANAAAEISAAEKQELQNKMAKLLAMLDEVDRKYKHYYHQMQIVVSSFDMVAGSGAAKPYTAVALQTISRHFRCLKDAISDQVNVIRKKLGEEENSSGREGKLTRLRYIDQQLRQQRAFQQYGMLQQNAWRPQRGLPENSVSILRAWLFEHFLDPYPKDSEKLMLARQTGLTRSQISNWFINARVRLWKPMIEDMYKEETGDAELDSNSSSENVPRSKDKVASSEEMQDLKCSMLAESKGNFGMVDLTGAPTSFHNEVNSDDGFMNLLLKDQRPGETDASLLHDAIAHHSDESARFMAYHLAELGGNGNSNVSLTLGLQHTENSLSAPNTHQPGYVAVREEDIYNTTAPPGVATASTDYESTNQMDQRQRFKQSPLLHDFVA

SEQ ID NO: 2906 - protein, 112 aa, Zea mays
MRASINRPPTPSAEEDRDKQPSLGEIINIKLVETGEKEKLMELLRERLAECGWRDEMKALCRAYARKKGRNNVTVDDLIHVITPKGRASVPDSVKAELLQRIRSFLMSTTLR

SEQ ID NO: 2907 - protein, 112 aa, Pennisetum glaucum
MRASINRPPTPSADEDRDKEPSLEEVINIKLVESGEKEKLIELLRERLVECGWRDEMKALCRAYARKKGRNNVTVDDLIHVITPKGRASVPDSVKAELLQRIRSFLMSTSLR

SEQ ID NO: 2908 - protein, 112 aa, Sorghum bicolor
MRASINRPPTPSAEEDRDKEPSLGEIINIKLVESGEKEKLMELLRERLVECGWRDEMKALCRAYARKKGRNNVTVDDLIHVITPKGRASVPDSVKAELLQRIRSFLMSTTLR

SEQ ID NO: 2909 - protein, 112 aa, Saccharum officinarum; identical to SEQ ID NO: 2908

SEQ ID NO: 2910 - protein, 112 aa, Panicum virgatum
MRASINRPPTPSAEEDRDKEPSLEEAINIKLVESGEKEKLMELLRERLVECGWRDEMKALCRAYARKKGRNNVTVDDLIHVITPKGRASVPDSVKAELLQRIRSFLMSTSRR

SEQ ID NO: 2911 - protein, 112 aa, Panicum virgatum
MRASINRPPTPSAEEDRDKEPSLEEAINIKLVESGEKEKLMELLRERLVECGWRDEMKALCRAYARKKGRNNVTVDDLIHVITPKGRASVPDSVKAELLQRIRSFLMSTSLR

SEQ ID NO: 2912 - protein, 249 aa, Zea mays
MARRIAVAAAFLALAVVAPAALAQAPGPAATPSGPPNVTAILEKGGQFTMFMRLMKETQQDTQLNSQLNSSYASSGGGYTVFAPTDNAFNNLKPGTLNSLTQQQQVALVQGHVLPQFYSMDSFQTASNPVRTQASGRDGPYTLNITATANNQVNVSSGVAEVTINNALSAVKPLAVYSVDKVLLPLELFGAKAPAAAPAASQGKPKKGGSSDAPSGSAGSDDAAPTGAAGARAVGWSFAGLAAVLGSLL

SEQ ID NO: 2913 - protein, 248 aa, Sorghum bicolor
MARRIAVAAAAFLALSAVVPAALAQAPGPAATPSGPPNVTAVLEKGGQYTMFMRLMKETQQDTQLNSQLNSSFASNGGGYTVFAPTDNAFNSLKPGTLNSLTQQQQVALVQGHVLPQFYSMDSFQTASNPVRTQASGRDGPYTLNVTSTTNNQLNVSTGVVEVTVNNALSAVKPLAVYSVDKVLLPLELFGAKAPAAAPTASKPKKGGSDDAASGPAGSDDAAPTGAASARAVGWSVAGLAALLGYLL

SEQ ID NO: 2914 - protein, 224 aa, Saccharum officinarum
  misc_feature (195)..(195): Xaa can be any naturally occurring amino acid
  misc_feature (199)..(199): Xaa can be any naturally occurring amino acid
  misc_feature (211)..(211): Xaa can be any naturally occurring amino acid
  misc_feature (217)..(217): Xaa can be any naturally occurring amino acid
MASRIAVAAAFLALAVVPAALAQAPGPAATPSGPPNVTAILEKGGQYTTFIRLMKETQQDTQLNSQLNSSYASNGGGYTVFAPTDNAFNNLKPGTLNSLTQQQQVALVQGHVLPQFYSMDSFQTASNPVRTQASGRDGPYTLNITATTTNQLNVSTGVVEVTVNNALSAVKPLAVYSVDKVLLPLELFGAKAPAXAPTXLKPKKGESSDAXFGPGGXDDAGPTG

SEQ ID NO: 2915 - protein, 247 aa, Saccharum officinarum
MASRIAVAAAFLALAVVPAALAQAPGPAATPSGPPNVTAILEKGGQYTTFIRLMKETQQDTQLNSQLNSSYASNGGEYTVFAPTDNAFNNLKPGTLNSLTQQQQVALVQGHVLPQFYSMDSFQTASNPVRTQASGRDGPYTLNITATTNNQLNVSTGVVEVTVNNALSAVKPLAVYSVDKVLLPFELFGAKAPAAAPTASKPKKGGSSDAASGPAGADDAAPTGAASSARAVGWSVAGLAAVLGYLL

SEQ ID NO: 2916 - protein, 246 aa, Panicum virgatum
MAGRIAVAAAFLALAVVPAALAQAPGPAAAPSGPPNVTAILEKGGQYTTFIRLMKETQQDTQLNSQLNSSFGNNGGGYTVFAPTDNAFNNLKPGTLNSLTQQQQVSLVQGHILPSFYSMDSFQTASNPVRTQASGRDGPYTLNITSDTNNQVNVSSGVVEVRINNALYSAKPLAVYSVDKVLLPMELFGAKAPAAAPTASEGKPKKGGSSDASSPAGSEDSDTGAASARAVGWSVAGLAAVLGYLL

SEQ ID NO: 2917 - protein, 250 aa, Panicum virgatum
MAGRRIAVAAAFLALAAVVPAALAQAPGPAAAPSGPPNVTAILEKGGQYTTFIRLMKETQQDTQLNSQLNSSFGNNGGGGYTVFAPTDNAFNNLKPGTLNSLTQQQQVSLVQGHVLPNFYSMDSFQTASNPVRTQASGRDGPYTLNITSDTNNQVNVSSGVVDVRINNALYNAKPLAVYSVDKVLLPMELFGAKAPAAAPTASEGKPRKGGSSDASSPAGSEDAEPTGAASARAVGWSVAGLAAVLGYLL

SEQ ID NO: 2918 - protein, 776 aa, Brachypodium distachyon
MERCRIWWPRQQLQPGLESGSARYVLLGWLFSRAGSVDIVVADFVSEGEILRSFPSVDTFQTIILSSNKRMPVRLQESAAFTILGDCVMHLPRDFEVCCCKQKCQPLHTQVFQKQHFDTNQGSSVVSNGSLGSENLPRGENNRNQECDCSVLDGFMDTCKKSVVKGGKWVHFCCKSEKSFGCNMNQIPVLHHLYLDNQKVELNHLHVILYDVPIAGRSHFSLGEDAPHRLKTPFKVPNWINNLQKKPSVLDLDPIVLALNCSNAAKLPVAWKTAANSSVAHVFFATIFDALVQVVQHFTGVFFTFVSTIVYIIIQLFQKCLSHMPEYFMLQKVFRHSWRNIHIRSCQILYWPIFLQDTSLRDVTVWSRLFDRFGPWWHTRKLTVAVDEAEPEASSCCYMWSSSVNVEYAHRAAIQKHALWSSIIIDLLMGFILGAALLLNTEIICSWTFALLHYMTDAVLRSGCVWLMGVPAGFKLNTELAELLGMISLNAIQIYSTLWFIMGGVLRHIVRGLAFSGILFGFTVPVSFFIDIIQLATLHVTMLQWLVSLIYSRQIQTVTSLWRLFRGRKWNPLRQRLDSYDYTVEQHVVGSLLFTPVLLLLPTASIFYVFFTMLSSTIICLCIVLEIAICIIHCTPYAALILWVTRRQRFPAGLLLLPVSLSSVCTDEEDAQSVEYCSASGFGDRQTDHLVHVHPGPLVSRLHCNYNTIGQVIGPHYRKAFDGIALSFCKQLAHGILSGARIPTTLHLPSSPFPWMHIGIRQYWMLCRDATKQGWN

SEQ ID NO: 2919 - protein, 214 aa, Hordeum vulgare
MEVKLWNDKRERELLESLADLYAIIKATEKLERAYVRDLVSAADYEADCLKLISQFNSLSSSLAGVVTIPRFVQAYRLDCPAALNRLVQSGVPATIELRAATASSSAPPATAASASAIAQCVQSFITAMDALKLNMLANDQVRPLLHDLSTSMGKLGTVLPPDFEGKVKVNEWLARLHKMGAGDELTDQQARQLNFDLESAYSAFMASLPTAGM

SEQ ID NO: 2920 - protein, 213 aa, Brachypodium distachyon
MEVKLWNDKRERELLESLADLYAIIKATEKLERAYVRDLVSAADYEAECLKLISQFNSLSSSLAGVVTIPRFVQAYRLDCPAALNRLVQSGVPATVELRASTNSSAPAATAASAAAIAQCVQSFITAMDAVKLNMLANDQVRPLLHDLSTSMGKLGTVLPPDFEGKVKVNEWLAKLHKMGAGDELTEQQARQLNFDLDSAYSAFMASLPTAGL

SEQ ID NO: 2921 - protein, 213 aa, Zea mays
MEVKLWNDKRERELLESYADLYAIIKAVEKLERAYVRDLVSAADYEAECLKLISQFNSLSSSLAGAVTVPRFVQAYRLDCPAALNRLLQSGVPATVELRAASASSAPAATAASASAIAHCVQTFITAMDAVKLNMLANDQVRPLLQDVATSMARLGSLLPPDFEGKVKVNEWLAKLHKMGAADELTEQQARQLNFDLDSAYSAFLAALPAAGL

SEQ ID NO: 2922 - protein, 213 aa, Zea mays
MEVKLWNDKRERELLESYADLYAIIKVTEKLERAYVRDLVSAADYEAECLKLISQFNSLSSSLAGTVAVPRFVQAYRLDCPAALNRLLQSGVPATVELRAASASSAPAATSASAAAIAHCVQTFITAMDAVKLNMLANDQVRPLLQDVATSMARLGSLLPPDFEGKVKVNEWLGKLHKMGAADELTEQQARQLNFDLDSAYSAFLAALPAAGL

SEQ ID NO: 2923 - protein, 213 aa, Sorghum bicolor
MEVKLWNDKRERELLESYADLYAIIKSTEKLERAYVRDLVSAADYEAECLKLISQFNSLSSSLAGAVTVPRFVQAYRLDCPAALNRLLQSGVPATVELRAASASSAPAATATSAAAIAHCVQTFITAMDAVKLNMLANDQVRPLLQDVATSMARLGPLLPPDFEGKVKVNEWLGKLHKMGAADELTEQQARQLNFDLDSAYSAFLAALPAAGL

SEQ ID NO: 2924 - protein, 213 aa, Saccharum officinarum
MEVKLWNDKRERELLESYADLYAIIKATEKLERAYVRDLVSAADYEAECLKLISQFNSLSSSLAGAVTVPRFVQAYRLDCPAALNRLLQSGVPATVELRAASASSAPAAAAASAAAIAHCVQTFITAMDAVKLNMLANDQVRPLLQDVATSMARLGPLLPPDFEGKVKVNEWLGKLHKMGAADELTEQQARQLNFDLDSAYSAFLAALPAAGL

SEQ ID NO: 2925 - protein, 212 aa, Panicum virgatum
MEVKLWNDKRERELLESYADLYAIIKATEKLERAYVRDLVSAADYEAECLKLISQFNSLSSSLAGAVTVPRFVQAYRLDCPAALNRLLQSGVPATVELRAASNSSAPAATAASAAAIAHCVQTFITAMDAVKLNMLANDQVRPLLQDVATSMARLGPLLPPDFEGKVKVNEWLGKLHKMGAADELTEQQARQLNFDLDSAYSAFLAALPASM

SEQ ID NO: 2926 - protein, 214 aa, Triticum aestivum
MEVKLWNDKRERELLESLADLYAIIKATEKLERAYVRDLVSAADYEADCLKLISQFNSLSSSLAGVVTIPRFVQAYRLDCPAALNRLVQSGVPATIELRAATASSSAPAATAASASAIAQCVQSFITAMDAVKLNMLANDQVRPLLHDLSTSMGKLGTVLPPDFEGKVKVNEWLAKLHKMGAGDELTDQQARQLNFDLESAYSAFMASLPTAGL

SEQ ID NO: 2927 - protein, 366 aa, Brachypodium distachyon
MGVYLSTPKTEKLSEDGENDKLKFGLSSMQGWRATMEDAHSALLDLDKDTSFFGVFDGHGGKVVAKFCAKYLHREVLKSEVYSVGDLGTSVHRAFFRMDEMMRGQRGWRELQALGDKINQFTGMIEGLIWSPKGSDSNDQHDDWAFEEGPHSDFSGPTCGSTACVAIVRNSQLVVANAGDSRCVISRKGQAYNLSRDHKPELEAERERILKAGGYIQMGRVNGTINLARAIGDMEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPIDHEKNASASEQPSIEGKNDSAGEQLAAGNTEQP

SEQ ID NO: 2928 - protein, 365 aa, Zea mays
MGVYLSTPKTEKVSEDGENDKLKFGVSSMQGWRTTMEDAHSALLDLDNDTAFFGVFDGHGGKVVAKFCAKYLHREVLRSEAYAAGDLGAAVHRAYFRMDEMMRGQRGWRELQALGDKINQFSGIIEGLIWSPKASDSNDRHDDWAFEEGPHSDFTGPNCGSTACVALIRNKQLVVANAGDSRCVISRNGQAYNLSRDHKPELEAERERIRSAGGFVLMGRVNGNLNLSRAIGDMKFKQNKFLPPDKQILTANPDINIVELCDDDEFIVLACDGIWDCMSSQQLVDFIREHIDTEESLSAVCERVLDRCLAPSTMGGEGCDNMTMILVQFKKPIAQVEDASGAEPAEDAGCCETHGAHENGSGKQV

SEQ ID NO: 2929 - protein, 366 aa, Zea mays
MVIYLSTPKTDKVSEDGENDKLKFGLSSMQGWRATMEDAHSALLDLDNDTASFGVFDGHGGKVVAKFCAKYLHIEVLHTEAYAAGDLGAAVHRAYLRMDEMMRGQRGWQELQALGDKINQFTGITEGLIWSPKASDSNDRHDDWAFEEGPHSDFTGPNCGSTACVALVRNRQLVVANAGDSRCVISRNGQAYNLSRDHKPELEAERERIQSAGGYIKMGHVNGSLNLSRAIGDMELKQNKFLSPDKQILTANPDINIVELCDDDEFIVLACDGIWDCMSSQQLVDFIREHINTEESLSAVCEGVLDRCLAPSTMGGEGCDNMTMILVQFKKPFAQVKDASDAEQLTGDAGCSETHGAEENGSDKQI

SEQ ID NO: 2930 - protein, 359 aa, Zea mays
MGVYLSTPKTDKLSENGENDRLKFGLSSMQGWRATMEDAHSALLDLDSETAFFGVFDGHGGRVVAKFCAKYLHGQVLKSEAYSTGDLGTAVHRAFFRMDEMMQGQRGWRELSALGDKINKFSGMIEGLIWSPRGSDSNNQQDDWASEEGPHSDFAGPTCGSTACVALIRNTQLVVANAGDSRCVISRGGKAYNLSRDHKPELAAERERIMKAGGFIHMGRVNGSLNLSRAIGDVELKQNKFLPPEKQIVTANPDINVVELCDDDDFVVVACDGIWDCMSSQQLVDFIHERINTESSLSAVCERVLDRCLAPSTIAGDGCDNMTMILVQFKKPVDRNKKAEAAGQSASNVDEAKSRVAEE

SEQ ID NO: 2931 - protein, 354 aa, Zea mays
MGVYLSTPKTDKVSEDGENDKLKFGLSSMQGWRATMEDAHSALLDLDNDTAFFGVFDGHGGKVVAKFCAKYLHREVLHTEAYAAGDLGAAVHRAYLRMDEMMRGQRGWRELQALGDKINQFTGIIEGLIWSPKASDSNDRHDDWAFEEGPHSDFTGPNCGSTACVALVRNRQLVVANAGDSRCVISRNGQAYNLSRDHKPELEAERERIQSAGGYIKMGRVNGSLNLSRAIGDMELKQNKFLSPDKQILTANPDINIVELCDDDEFIVLACDGIWDCMSSQQLVDFIREHINTEESLSAVCERVLDRCLAPSTAGEGCDNMTMILVQFKKPFAQVKDASGAEQLTGDAGCSETQ

SEQ ID NO: 2932 - protein, 331 aa, Pennisetum glaucum
MACNYGRCSLSFARSRQRHCILGVFDGHGGKVVAKFCAKYLHREVINSEAYAAGDLGAAVHRAFFRMDEMMRGQRGWRELQALGDKINQFTGIIEGLIWSPKGSDSNDRHDEWAFKEGPHSDFIGPNCGSTACVALVRNRQLIVANAGDSRCVISRNGQAYNLSRDHKPELEAERERIQSAGGYIQMGRVNGTLNLSRAIGDMEFKQNKFLSPDKQILTANPDINIVELCDDDDFLVLACDGIWDCMSSQQLVDFIHEHIDKEETLSAVCERVLDRCLAPSTMGGEGCDNMTMILVQFKKPITQTKDASSAEQSAGDTEPSETHVAEENGS

SEQ ID NO: 2933 - protein, 362 aa, Oryza sativa
MGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEGPHSDFAGPTCGCTACVALIRNNQLVVANAGDSRCVISRAGQAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEINAAEENGS

SEQ ID NO: 2934 - protein, 1279 aa, Sorghum bicolor
MSSKKVPYHKHREAEEARKKREEDEAARVYAEFVESFKGDSSSGAKFVRGGVIDPNAKLKIDSEGGKSKDGGSVPKKGSRYVPSFLPPSFAKEPEKKKEEERPKEKEKGKPRVIDKFLEELKFEQEQRKKRNQDRDHRHEGRHSDSSMPSSRFDELPDEFDPTGRFPGSFDDGDPQTTNLYVGNLSPKVDENFLLRTFGRFGPIASVKIMWPRTEEERRRQRNCGFVAFMNRTDGQAAKDEMQGVVVYDYELKIGWGKSVALPSQALPAPPPGHMAIRNKEGGTVVLSGPGGPAVASVTPQTSELVLTPNVPDIVVAPPDDGRLRHVIDTMALHVLDGGCAFEQAVMERGRGNPIFDFLFDLKSKEHTYYVWRLYSFAQGDTLQRWRTEPYIMITGSGRWVPPPLSSNRSPEREKESTFAAGRSRRVEVERTLTESQRDEFEDMLRALTLERSQIKDAMGFALDNADAAGEIVEVLTESLTLKETSIPTKVARLMLVSDILHNSSAPVKNASAFRTKFEASLPDVMESFNDLYRSITGRITAEALKERVMKVLQVWADWFLFSDAFLNGLRATFLRSGNSGVVPFHSLCGDAPEIEKKGSSEDGNDGFKLNEDGALATGKAAATKELLGLPLAELERRCRHNGLSLCGGKEMMVARLLNLEEAEKERVYEKDVDMKYVQGEQHTIGSGVNTSKFGESPNVDELDVSRNNMRAGKGRSGESAFAELESFPSKKPKYDPVLPASKWSREDDISDDEDRKGGRGLGLSYSSGSDIADDLGKVDTTEASTDHTSHHHDTIVDEEHRQKLRQIEISVMQYRESLEEQGLRNLDEIERKVASHRRRLQSEYGLSTSADGANRRSSERTSSERKERRDDAHDYPRKRRRSQSRSRSPPRKSQERDREHNRSRDRSHGNDAGRDRLIRMGVYLSTPKTDKLSENGENDRLKFGLSSMQGWRATMEDAHSALLDLDSETAFFGVFDGHGGRVVAKFCAKYLHGQVLKSEAYSAGDLGAAVHRAFFRMDEMMRGQRGWRELSALGDKINKFSGMIEGLIWSPRGSDSNSQQDDWASEEGPHSDFAGPTCGSTACVALIRNSQLVVANAGDSRCVISRGGKAYNLSRDHKPELAVERERIMKAGGFIHMGRVNGSLNLSRAIGDVELKQNKFLPPEKQIVTANPDINVVELCDDDDFVVVACDGIWDCMSSQQLVDFIHERINMESSLSAVCERVLDRCLAPSTIGGDGCDNMTMILVQIKKPVNRNKKAEVAGQSANNADEVKSRVAEE

SEQ ID NO: 2935 - protein, 366 aa, Sorghum bicolor
MGVYLSTPKTEKVSEDGENDKLKFGLSSMQGWRATMEDAHSALLDLDNDTAFFGVFDGHGGKVVAKFCAKYLHREVLHSEAYAAGDLGAAVHRAYFRMDEMMRGQRGWRELQALGDKINQFTGIIEGLIWSPKASDSNDRHDDWAFEEGPHSDFTGPNCGSTACVALVRNRQLVVGNAGDSRCVISRNGQAYNLSRDHKPELEAERERIQSAGGYIQMGRVNGTLNLSRAIGDMEFKQNKFLSPDKQILTANPDINIIELCDDDEFMVLACDGIWDCMSSQQLVDFIREHINTEESLSAVCERVLDRCLAPSTMGGEGCDNMTMILVQFKKLTAQHKDASGAQQPAGDAGCSETHGAEENGSGKQV

SEQ ID NO: 2936 - protein, 359 aa, Saccharum officinarum
MGVYLSTPKTDKLSENGENDRLKFGLSSMQGWRATMEDAHSALLDLDNETAFFGVFDGHGGRVVAKFCAKYLHGQVLKSEAYSAGDLGAAVHRAFFRMDEMMRGQRGWRELSALGDKINKFSGMIEGLIWSPRGSDSNSQQDDWASEEGPHSDFAGPTCGSTACVALIRNSQLVVANAGDSRCVISRGGKAYNLSRDHKPELAVERERIMKAGGFIHMGRVNGSLNLSRAIGDVELKQNKFLPPEKQIVTANPDINVVELCDDDDFVVVACDGIWDCMSSQQLVDFIHERINMESSLSAVCERVLDRCLAPSTIAGDGCDNMTMILVQFKKPVDRNKKAEVAGQSANNADEVKSRVAEE

SEQ ID NO: 2937 - protein, 359 aa, Panicum virgatum
MGVYLSTPKTDKLSENGENDRLKFGLSSMQGWRASMEDAHSALLDLDSETAFFGVFDGHGGRVVAKFCAKYLHSQVLKSDAYSTGDLGSAVHRAFFRMDEMMRGQRGWRELSALGDKINKFSGMIEGLIWSPRGSDSNNQQDDWASEEGPHSDFAGPTCGCTACVALIRNNQLIVANAGDSRCVISRAGQAYNLSRDHKPELAAERERIMKAGGFIHMGRVNGSLNLSRAIGDVEFKQNKFLPPEKQIVTANPDINVVELCDEDDFVVVACDGIWDCMSSQQLVNFIHEHINKESSLSAVCEKVLDRCLAPSTITGEGCDNMTMILVQFKKPVNRNKMSDMAEQSTSSADETEIHVAEE

SEQ ID NO: 2938 - protein, 236 aa, Triticum aestivum
MGVYLSTPKTDKLSEDGENDKLKFGLSSMQGWRASMEDAHSALLDLDNETAFFGVFDGHGGRVVAKFCAKYLHSQVLKSEAYSSGDLGTAVHKAFFRMDEMMRGQRGWRELSALGDKMNKFSGMIEGLIWSPRGSDSKNAEDDWALEEGPHSDFDGPTCGSTACVALVRNNQLVVANAGDSRCVISRAGQAYNLSRDHKPELVAERERILKAGGFIRMGRINGSLNLARAIGRYGI

SEQ ID NO: 2939 - protein, 411 aa, Triticum aestivum
MGVYLSTPKTEKLSEDGENDQLKFGLSSMQGWRASMEDAHSALLDIDEDTSFFGVFDGHGGKVVAKFCAKYLHREVLKSEVYLAGDLGAAVHGAFFRMDEMMRGQRGWRELQALGDKINQFTGMIEGLIWSPRGSDSNDRHDDWAFEEGPHSDFSGPTCGSTACVAMIRNSQLVVANAGDSRCVISRNGQAYNLSRDHKPELEAERERILKAGGYIQMGRVNGTINLSRAIGDMEFKQNKFLSPDKQMLTANPDVNTVELCDDDDFLVLACDGIWDCMSSQQLVDFIHEHLKTESSLSAVCEKVLDRCLAPSTLGGEGCDNMTMILVQFKKPIDHGKNASAGEQSAVGDKNVSAGEQSTAEDKNASASDQSAVEDKNASAGGQSAVGDKNASAGGQSPGDIEQSANEEKNS

SEQ ID NO: 2940 - protein, 625 aa, Panicum virgatum
MDDSFMNIPHPPPMNDPFVLGCSAPSSTMENIGQSTFCMDGLSPTTANCSHVNGNTQIMNDIAARDDGSRLVLGLGPTPNFYSADCQSIGSKQAQRLSGQSSTFIDPGMLRLGLQMDGGEAIQCLQLPNGTVHSFCVVDEASTSATVRNMGGYMPSLLFAPRSNSTVNEAQVEIPDSLDLTHSTNSSQHLQHHLQLSPEPSAMTESSFGVSSDVVTAATTSEQRSHPRHPKKCRFKGCSKGARGASGLCIAHGGGQRCHKPGCHKGAESSSAYCKAHGGGRRCEELGCTKSAEGKTDYCIAHGGGHRCEHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVAHGGGKRCSVPGCTKSARGRTDCCVKHGGGKRCKVDNCGKSAQGSTDFCKAHGGGKRCTWSTGCEKFSRGKSGFCAAHGTLMARQREQEAVKNVGSMIGPGLFSSIVVSSATMGSSMTNELSSSGISTASDCDGTVRSQSMIPPQVLVPRSMMPPWSSEPVDGGREGGHVVPEGRVHGGGLLSLLGGSFRNADVEKL

SEQ ID NO: 2941 - protein, 236 aa, Zea mays
MGACASVHKDPGHPKKQFLDSPTKAKAANGKGGGGGGVAPVGDGFGDLKSKVDAEAEQLRAEFNPKNPDSGSKDEVFFESRAWLDSDCEDDFYSVNGDFTPSRGSTPVYQPRAQTVMSSIFQPDTRSSKSPEPSPTGRRKLAELLQEAMQDGPEESADEEEQQQQSLSAAADGKPPVSESTSSSACSTVPTPVAVAKSRKEKAWYTGRCCLPSFVHSLTLDESERGQKMSSRPCAV

SEQ ID NO: 2942 - protein, 228 aa, Zea mays
MGACASVHKDPGYPKEQFLDSPTKAEAANEKGGCGGGDDDFADFKSKVDAEQQRAELNPKSPDSGSKDEVFFESRAWLDSDCEDDFYSVNGDFTPSRGSTPIHQPRAQTVMSNIFQPDTHGSKSPEPSPTGRRKLAELLQEAMQNGPEESTDQELQLRSVAADGKPVSESTSSSACSTVTTPIAVANAKSRKEKAWYTGRCCLPSFVHSLTLDESERAQKMSSRPCAV

SEQ ID NO: 2943 - protein, 85 aa, Saccharum officinarum
  misc_feature (47)..(47): Xaa can be any naturally occurring amino acid
MGACASVHKDPEYPKKQFLDSPTKAKAANGKGGGGGGGTAALLRLVXALVTSRPRSTLSSSGQSLTPRARILVARMKCSSSLELG

SEQ ID NO: 2944 - protein, 234 aa, Panicum virgatum
MGSCASVDKKDPGFPKKQFLASTTKAKAANGKGGGVAPVGDGFGDLNSKIEAEQQRGGFGPKSPDSGSNDEMFFESRAWLDSDCEDDFYSVNGDFTPSRGSTPNYQPRTQTVMTNIFRPDNLDKSKSSEASPTGRRKLAELLQEAMQSGDEESTYVVSKDEKQQLQSVAVDGKPVSESTSSSACSTEPTPTMVTKGRKEKAWYTGRCCLPSFVHSLTLDEGERGQKVSSRPCAV

SEQ ID NO: 2945 - protein, 407 aa, Zea mays; identical to SEQ ID NO: 387

SEQ ID NO: 2946 - protein, 384 aa, Oryza sativa; identical to SEQ ID NO: 446

SEQ ID NO: 2947 - protein, 409 aa, Sorghum bicolor
MAAVFFHHVVGDLTVGKPEVAELHDTDTLDDAARAIAASPEGAVPVWRPRAAPYDPPSGARFIGMISALDIAAFVAAAGVGDRAMRAVVGEVVQPNPALLREIDPGTRLIDALELMRHGVKRFLVRKSGSWKGITKRFSVLFNGKWLKNMESTSPNAASSSSMPLSPPSGSADKFCCLSREDVLRFLIGCLGALAPIPLTQISSLGAINPQYSYVEASAPAMEAIQKIPQDPCAVAVVETAPDGTRKILGDISTYKLWKCDYVSAAWALANLSAGQFVLGADENGSMPISVFPEPPISPSSPVEEISPGRSPRAKKFSSRSIGFLSNTQASQMSAWRTRSAYHRGRSTPLMCKTTSTLAAVMAQMLSHRATHVWVTDAESEDGVLVGVVGYTEIFNAATRSTCASPTTS

SEQ ID NO: 2948 - protein, 399 aa, Zea mays
MNGSSGSQGHHVSGEKKQVCHVSRPILNNGPKHRPLTPMRRCRGVACVVIILSTAFLLVVYLAPITTFAVRLFSVHYSRKATSFLFGMWLSLWPFLFEKINKTKVVFSGENVPPKRRVLLFANHRTEVDWMYLWDLALRKGHLGYIKYILKSSLMKLPIFSWAFHIFEFIPVERKWEIDEAIIQNKLSKFKNPRDPIWLAVFPEGTDYTEKKCIMSQEYASEHGLPMLEHVLLPKTKGFICCLQELRSSLDAVYDVTIAYKHRLPDFLDNVYGVDPSEVHIHVRMVQLHHIPTTEDKITEWMVERFRQKDQLLADFFMKGHFPDEGTEGDLSTPKCLANFLTVVCLTAICLYLTLFSFVWFKVYVVASCAYLSFVTYYSILPPQLIGSPEGDVKAKKVV

SEQ ID NO: 2949 - protein, 399 aa, Sorghum bicolor
MNGSSGSQGHHVSGEKQQVHHVSRPILNNGPKHRPLTPMRRCRGVACVAIILSTAFLLIVYLAPITTFVVRLFSVHYSRKATSFLFGIWLSLWPFLFEKINKTKVVFSGENVPPKRRVLLFANHRTEVDWMYLWDLALRKGHLGYIKYILKSSLMKLPIFSWAFHIFEFIPVERKWEIDEAIIQNKLSKFKNPRDPIWLAVFPEGTDYTEKKCIKSQEYASEHGLPKLEHVLLPKTKGFICCLQELRSSLDEVYDVTIAYKHRLPDFLDNVYGVDPSEVHIHIRTVQLHHIPTSEDEITEWMIERFRQKDQLLSDFFVKGHFPDEGMEGDLSTPKCLANFLTVVGLTVICLYLTLFSSVWFKVYVLASCAYLSFVTYYSILPPQLIGSPEGDVKAKKAV

SEQ ID NO: 2950 - protein, 396 aa, Panicum virgatum
MNGSNGSQEHHVNGEEKVVHHVNRPILNNGPKHRPFTPMRRCRGVACVAIILSTAFLLIVYLAPITTFVVRLFSVHYSRKATSILFGIWLSLWPFLFEKINKTKVVFSGENVTPKRRVLLFANHRTEVDWMYLWDLALRKGYLGYIKYILKSSLMKLPIFSWAFHIFEFIPVERKWEIDEAIIQNKLSKFKNPRDPIWLSVFPEGTDYTEKKCIMSQEYASEHGLPKLEHVLLPKTKGFICCLQQLRSSLDAVYDVTIAYKHRLPDFLDNVYGVDPSEVHIHIRTVQLSDIPTSEDEITEWMIERFRQKDKLLSDFLAKGHFPDEGTEGDLSTPKCLANFFTIVGLTGICLYLTLCSSVWFKVYVVASCAYLSFVTYYSILPPQLVGSPEGAKKAV

SEQ ID NO: 2951 - protein, 379 aa, Brachypodium distachyon
MSSLCPFAKATTGGGGVCPMKSDKNSSTVKSNKNDSSSVCPVTGKNNGEEHKESGTDHAGEESPDPRMVPAKCPFGYDSNTFKLGPLSCMVCQALLHDTSKCKPCSHKFCKTCISRFKDCPLCGADIEGVEPDPELQALVDRFIDGHARIKRSLAGGGVEEVDGKSKVIYEDVSMERGAFLVQQAMRAFRAQNIESAKSRLSMCAEDIREELKSAEDNLDLCSQLGAVLGMLGDCCRTLGDASSAITYYEESAEFLSKLPTKDLELVHTLSVSLNKVGDLRYYGGDLQSARSYYARSLSVRQKAVKEHPSVASQVIDLATSLAKVADVDRNLGNQDAAVEGFEEAIKSLEKLNLDSEQAGLEQRRRSVLDFLHKQLDSK

SEQ ID NO: 2952 - protein, 380 aa, Brachypodium distachyon
MSSLCPFAKATTGGGGVCPMKSNKNSTVKSNKNDSSSVCPVTGKNNGEEHEESGTDHAGEESPDPRVVPAKCPFGYDSNTFKLGPLSCMVCQALLHDTSKCKPCSHKFCKACISRFKDCPLCGADIEGVEPDPELQALDDRFIDGHARIKRSLAGGGEEEVDGKSKVIYEDVSMERGAFLVQQAMRAFRAQNIESAKSRLSMCAEDIREELKSAEDNLDLCSQLGAVLGMLGDCCRTLGDASSAITYYEESAEFLSKLPTKDLELVHTLSVSLNKVGDLRYYGGDLQSARSYYARSLSVRQRAVKEHSSVASQVIDLATSLAKVADVDRNLGNQEAAVEGFEEAIKCLEKLNLEDSEQAGLEQRRRSVLDFLHKQLDAKY

SEQ ID NO: 2953 - protein, 368 aa, Festuca arundinacea
  misc_feature (27)..(27): Xaa can be any naturally occurring amino acid
  misc_feature (230)..(230): Xaa can be any naturally occurring amino acid
MSSLCPFAKATTGGVCPMKSDKKPDKXGSGACPVAGKSHDKESGAEDRAGGDEDPRLVPAKCPFGYDSNTFKLGPLSCMVCQALLHDASKCKPCLHKFCKACISRFKDCPLCGADVEGIEPDTELQALVDRFIDGHARIKRSLAGGDGEAAGGKGKVIYEDVSMERGAFLVQQAMRAFRAQNIESAKSRLSMCAEDIREELKSSQDNLDLCSQLGAVLGMLGDCCRTLGXAPSAITYYEESAEFLSKLPTKDLELVHTLSVSLNKVGDLRYYDGDLQSARSYYARSLEVRRNSVKEHSAVASQVIDLATSLAKVADVDRNLGNEEAAVKGFEEAIKCLENLKLDSEQASLEQRRCSVLDFLQKQLDGK

SEQ ID NO: 2954 - protein, 338 aa, Leymus cinereus x Leymus triticoides
  misc_feature (45)..(46): Xaa can be any naturally occurring amino acid
  misc_feature (173)..(173): Xaa can be any naturally occurring amino acid
  misc_feature (223)..(224): Xaa can be any naturally occurring amino acid
  misc_feature (327)..(327): Xaa can be any naturally occurring amino acid
  misc_feature (329)..(331): Xaa can be any naturally occurring amino acid
  misc_feature (333)..(333): Xaa can be any naturally occurring amino acid
  misc_feature (335)..(335): Xaa can be any naturally occurring amino acid
MVCQALLHDASKCKPCSHKFCKACISRFKDCPLCGADIEGFEPDXXLQALVDRFIDGHARIKRSLAGGDDQAADGKSKVIYEDVSMERGAFLVQQAMRAFRAQNIESAKSRLSMCAEDIREELKSSEDNLDLCSQLGAVLGMLGDCCRTLGDAPSAITYYEESAELLSKLPKXDLELVHTLSVSLNKVGDLRYYDGDLQSARSYYARSLDVRRNSVKEHSAVXXQVIDLATSLAKVADVDRNLGNEDAAVEGFEEAIKCLEKLKLDSEQASLEQRVATICPFVFVSWCVLFWTNFRSVLFSASLGSRLPAEAIARQVRQMAPVCTTXKXXXPXCXVAI

SEQ ID NO: 2955 - protein, 379 aa, Zea mays
MSSICPFAGATTGGGVCPVKSDKSNTGVCPAKSDKSISGVCPVTGKDHGSKLKESGDHGEEKGTDPRVVPAKCPFGYDSNTFKLGPLSCIVCQALLHESSKCKPCAHKFCKACISRFKDCPLCGADIEGIEPDAELQALVDRFIDGHARIKRSHAAGDVEAADGKNKVIYEDVSMERGAFLVQQAMRAFRARNIESAKSRLTMCADDIREELKSSEDNLDLCSQLGAVLGMLGDCCRTLGDVPAAITYYEESAEFLSKPPAKDLELVHTLSVSLNKIGDLRYYDGDLQSARSYYARSLDVRRNAVKEHSAVASQVIDLATSLAKVADVDRNLGNESTAVEGFEEAIRCLEKLKLDSEQTTLEQRRLSVLDFLHNQLADK

SEQ ID NO: 2956 - protein, 379 aa, Pennisetum glaucum
MSSLCPFAGATSGSGVCPVKSDKSGAGVCPAKSDKSISGVCPVTGKDNTSEHKESTDNAEEKGTDPRMVPAKCPFGYDSNTFKLGPLSCIICQALLHESSKCKPCAHKFCKACISRFKDCPLCGADIEGIEPDAELQALVDRFIDGHARIKRSHAAGDVEAAGGKNKVIYEDVSMERGAFLVQQAMRAFRAQNIESAKSRLTMCADDIREELKSSEDNLDLCSQLGAVLGMLGDCCRTLGDAPSAITYYEESSEFLSKLPTKDLELVHTLSVSLNKIGDLRYYDGDLQSARNYYARSLDVRRNAVKEHSAVASQVIDLATSLAKVADVERNLGNESAAVEGFEEAIRCLEKLKLDSEQANLEQKRLSVLDFLHKQLADK

SEQ ID NO: 2957 - protein, 374 aa, Pseudoroegneria spicata
MSSLCPFAKATTGGVCPVKSDKKPDKSGGSACPVTGKSHGSENKESGADRAAGEESAEDPHVVPAKCPFGYDSNTFKLGPLSCMVCQALLHDASKCKPCSHKFCKACISRFKDCPLCGADIEGFEPDTELQALVDRFIDGHARIKRSLAGESKEAGADGKSKVIYEDVSMERGAFLVQQAMRAFRAQNIESAKSRLSMCAEDIREELKSSEDNLDLCSQLGAVLGMLGDCCRTLGDAPSAITYYEESAELLSKLPKKDLELVHTLSVSLNKVGDLRYYDGDLQSARSYYARSLDVRRNSVKEHSAVASQVIDLATSLAKVADVDRNLGNEDAAVGGFEEAIKCLEKLKLDSEQASLEQRRRSVLDFLQKQLHDK

SEQ ID NO: 2958 - protein, 379 aa, Sorghum bicolor
MSSLCPFARATNGGGVCPVKSDKSNAGVCPAKSDKSISGVCPVTGKDHGSELKESSDHGEEKSTDPRVVPAKCPFGYDSNMFKLGPLSCIVCQALLHESSKCKPCAHKFCKACISRFKDCPLCGADIEGIEPDAELQTLVDRFIDGHARIKRSHAKGDVEAAGGKNKVIYEDVSMERGAFLVQQAMRAFRAQNIESAKSRLTMCADDIREELKSSEANLDLCSQLGAVLGMLGDCCRTLGDVPSAITYYEESAEFLSKPPAKDLELVHTLSVSLNKIGDLRYYDGDLQSARNYYARSLDVRRNAVKEHSAVASQVIDLATSLAKVADVDRNLGNESAAVEGFEEAIQCLEKLKLDSEQASLEQRRLSVLDFLNNQLADK

SEQ ID NO: 2959 - protein, 382 aa, Sorghum bicolor
MSSCCPFAGATTGGGVCPVKATDQSSAGLCPAAKSDKSITGVCPVTGKGHGSEHKESIDGGEEKGTDDPRMVPAKCPFGYDSNTFKLGPLSCIVCQALLHESSKCKPCAHKFCKACISRFKDCPLCGADIEGIEPDAELQALVDRFIDGHARIKRLHATGDVEAADFKDKVIYEDVSMERGAFLVQQAMRAFRAKNIESAKSRLTMCADDIREELKSSEDNLDLCSQLGAVLGMLGDCCRTLGDSPSAITHYEESAEILSKLPTKDLELVHTLSVSLNKIGDLRYYDGDLQSARNYYARSLDVRRNAVKEHSAVASQVIDLATSLAKVADVDRNLGNESTAVQGFEEAIQCLEKLKLDSEQASLEQRRLSVLDFLHNQLADK

SEQ ID NO: 2960 - protein, 382 aa, Saccharum officinarum
MSSRCPFAGATTGGGVCPVKAADKSSAELCPAAKSDKSITGVCPVTGKGHGSEHKESTDGGEEKGTDDPRMVPAKCPFGYDSNTFKLGPLSCIVCQALLHESSKCKPCAHKFCKACISRFKDCPLCGADIEGIEPDAELQALVDRFVDGHARIKRSHATGDVEAADCKDKVIYEDVSMERGAFLVQQAMRAFRAQNIESAKSRLTMCADDIREELKSSEDNLDLCSQLGAVLGMLGDCCRTLGDAPSAITHYEESAEILSKLPTKDLELVHTLSVSLNKIGDLRYYDGDLQSARNYYARSLDVRRNAVKEHSAVASQVIDLATSLAKVADVDRNLGNESTAVDGFEEAIQCLEKLKLDSEQASLEQRRLSVLQFLHNQLADK

SEQ ID NO: 2961 - protein, 378 aa, Saccharum officinarum
  misc_feature (45)..(45): Xaa can be any naturally occurring amino acid
  misc_feature (144)..(144): Xaa can be any naturally occurring amino acid
  misc_feature (164)..(164): Xaa can be any naturally occurring amino acid
MSSLCPFAGATTGGVCPVKSDKSNAGVCPAKSDKSISGVCPVTGXDHGSELKESSDHGEEKGTDPRMVPAKCPFGYDSNTFKLGPLSCIVCQALLHESSKCKPCAHKFCKACISRFKDCPLCGADIEGIEPDAELQALVDRFIXGHARIKRSHATGDVEAAGGXNKVIYEDVSMERGAFLVQQAMRAFRAQNIESAKSRLTMCADDIREELKSSEANLDLCSQLGAVLGMLGDCCRTLGDVPSAITYYEESAEFLSKPRAKDLELVHTLSVSLNKIGDLRYYDGDLQSARNYYARSLDVRRNAVKEHSAVASQVIDLATSLAKVADVDRNLGNESAAVEGFEEAIQCLEKLKLDSEQASLEQRRLSVLDFLHNQLADK

SEQ ID NO: 2962 - protein, 379 aa, Panicum virgatum
MSSLCPFAGATTGGGVCPAKSDKSSAGVCPAKSDKSISGVCPVTGKDHSSEHKGSTGHAEDKGTDPRMVPAKCPFGYDSNTFKLGPLSCIICQALLHESSKCKPCAHKFCKACISRFKDCPLCGADIEGIEPDTELQALVDRFIDGHARIKRSHAAGDVEAAGGNNKVIYEDVSMERGAFLVQQAMRAFRAQNIESAKSRFTMCADDIREELKSSEDNLDLCSQLGAVLGMLGDCCRTLGDAPSAITYYEESAEFLSKLPTKDLELVHTLSVSLNKIGDLRYYDGDLQSARNYYARSLDVRRNAVKEHSTVASQVIDLATSLAKVADVDRNLGNESAAVEGFEEAIQCLEKLKLDSKQANLEQRRFSVLDFLHNQLADK

SEQ ID NO: 2963 - protein, 375 aa, Triticum aestivum
MSSLCPFAKATTGGVCPMKSDKKPDKSGGGAACPVTGKSHGSENKESGADRAAGEEGAEEDPRVVPAKCPFGYDSNTFKLGPLSCMVCQALLHDASKCMPCSHKFCKACISRFKDCPLCGADIEGIEPDAELQALVDRFIDGHARIKRSLAGENNQAADGKSKVIYEDVSMERGAFLVQQAMRAFRAQNIESAKSRLSMCAEDIREELKSSEDNLDLCSQLGAVLGMLGDCCRTLGDAPSAITYYEESAELLSKLPKKDLELVHTLSVSLNKVGDLRYYGGDLQSARSYYARSLDVRRNSVKEHSAVASQVIDLATSLAKVADVDRNLGNEDAAVEGFEEAIKCLEKLKLDSEQASLEQRRCSVLDFLQKQLHDK

SEQ ID NO: 2964 - protein, 351 aa, Sorghum bicolor
MPEAEWNDERTRLVCELFEEQVQAGNRPNTHLNNIGYRQVAAKFQQRTQLLYTKLQLKNKWDKFKNDYITWRKLLVVGKGLPWDNAKGTFVADEEWWKKINKELPGARKFRHGGLQHEDKLKVMFDYITSNGVDPSPPAPESPKNGVDHSPPAATGLPEHSPVTAHGLPSGPDSHVNGTDHLPLATRDLPRIQETPMNGVNLDGSDNTEDNDYTHREPVFHYPSNRKKIPIHFSAAKKKKKNKSETALLMQAHLYRITELAQKAQDTFEKFSSQADSAPWPSIQDVMTLVRECGARCGSNEHFIATELFVSREQREMFLTMETAEERFQWLRRKYIVKYLSGTTGTSLGTR

SEQ ID NO: 2965 - protein, 572 aa, Brachypodium distachyon
MSTGGLSFVRRAVEAVRRTPRWQKRIVFFTVGVGTLSYACQDNRVLQINDGTGKKKLVILGTGWAGASFLRNIDTSLYDVHVVSPRNYFMFTPLLPSVTCGTVEARSIVEPIRNIVRKNGGAFRFWEAECYKIDPASKKIHCRSGDGTNVDGNGEFAVDYDYLVVTVGARPNTFNTPGVVENCHFLKEVEDAQKIRKSVMKCFEKAALPNLTEEERKKNVHFVVIGGGPTGVEFAAELHDFVNEDLAKLYPDVKKYVNISVIEAGDHILTMFDKRITHFAEDKFKREGIDLKTNFKVVKVSDKTITMSNPATGEIAVPYGLAVWSTGIGTRPIIMDFMKQVGQANRRVLATDEWLRVHGCEDVYALGDCATITQRKVMEDVDAIFRVADKDNSGTLTVKKIKDVLGDIYVRYPQVELYLKTNQMKGFHDLLKDKESEELNIEELKKALAQVDSQVKLLPATAQVAAQEGAYLADCFNRMNICEESPEGPLRIRGAGRHRFKPFRYRHLGQFAPLGGEQTAAQLPGDWIHVGHSTQWLWYSVYASKQFSWRTRMLVVSDWGRRFIFGRDSSSL

SEQ ID NO: 2966 - protein, 578 aa, Zea mays
MASNGSSLVRRAAAAVRRMPRWKKRLVFFAVGASTLTYACQDNRVLQICDVTGNKKKVVILGTGWAGASFLRNIDTSLYDVHVVSPRNYFTFTPLLPSVTCGTVEARSIVEPIRNIVRKRNGAFRFWEAECFKIDPTNKKVHCRSDVGTNINGNGEFVVDYDYLIVSVGARPNTFNTPGVTENCHFLKEVEDAQKIRKSVMKCFERAALPNLSEEERKKNLHFVIIGGGPTGVEFAAELHDFVNEDLAKLYPDVKKHVNISVIEAGGHILTMFDKRITQFAEEKFKRDGIDLKTNFKVVKVSNKDILMTNPATGEVAVPYGMAVWSTGIGTRPIIMDFMKQVGQENRRVLATDEWLRVQGCEDVYALGDCATIAQRKVMEDVAAIFRVADKDNSGTLTVKKIKDVLGDIYERYPQVELYLKSNQMKGFHDLLKDSDGSSKEFKELDIEQFKRALAQVDSQVKMLPATAQVAAQEGSYLADCFNRMKMCEEYPEGPIRIRGAGRHRFKPFRYKHLGQFAPLGGEQTAYQLPGDWVHVGHSTQWLWYSVYASKQFSWRTRMLVVSDWGRRFIFGRDSSSI

SEQ ID NO: 2967 - protein, 575 aa, Oryza sativa
MSASGGLSLVRRAVEAARRTPRWQKRLLVLTAGVGSLTYACQDNQVLQINDGTGKKRVVIVGTGWAGASFLRNIDTSLYDVHVVSPRNYFTFTPLLPSVTCGTVEARSIVEPIRNIVRKRGGAFRFWEAECYKIDPTNKKIHCRSDSDGNSEFVVDYDYLVVSVGARPNTFNTPGVVENCHFLKEVEDAQKIRKSVLKCFERASLPNLTEEERKKNLHFVVIGGGPTGVEFAAELHDFVNEDLAKLYPDVKKYANISVIEAGDHILTMFDKRITQFAEDKFKRTGIDLKTNFKVVKVSDKAITMTNSATGEIAVPYGMAVWSTGIGTRPLIMDFMKQVGQANRRVLATDEWLRVHGCDDVYALGDCATITQRKVMEDIASIFRVADKDNSGSLTVKKIKNVLGDIYERYPQVELYLKTNQMKDFHDLLKDSDGNAIKESKELNIEEFKKALARVDSQVKMLPATAQVASQEGAYLANCFNKMKYCEENPEGPLRIRGTGRHRFKPFRYRHLGQFAPLGGEQTAAQLPGDWIHVGHSTQWLWYSVYASKQFSWRTRMLVVSDWGRRFIYGRDSSSL

SEQ ID NO: 2968 - protein, 578 aa, Sorghum bicolor
MASNGLSLVRRAAEAVRRTPRWKKGLVFFAVGASTLTFACQDNRVLQICDGTGNKKKVVILGTGWAGASFLRNIDTSLYEVHVVSPRNYFTFTPLLPNVTCGTVEARSIVEPIRNIVRKRNGAFRFWEAECFKIDPANKKVHCRSDVGTNINGNGEFVVDYDYLIVSVGARPNTFNTPGVTENCHFLKEVEDAQKIRKSVMKCFERAALPNLSEEERKKNLHFVVIGGGPTGVEFAAELHDFVNEDLAKLYPDVKKYVNISVIEAGGHILTMFDKRITQFAEEKFKRDGIDLKTNFKVVKVSDNDITMTNTATGEVTVPYGMAVWSTGIGTRPIIMDFMKQVGQGNRRVLATDEWLRVQGCEDVYALGDCATIAQRKVMEDVAAIFRVADKDNSGTLTVKKIKDVLGDIYERYPQVELYLKSNQMKGFHDLLKDSDGSSKELKELDIEQFKKALAQVDSQVKMLPATAQVALQEGRYLADCFNRMKTCEEYPEGPIRIRGTGRHRFKPFRYRHLGQFAPLGGEQTAYQLPGDWVHVGHSTQWLWYSVYASKQFSWRTRMLVVSDWGKRFIFGRDSSSI

SEQ ID NO: 2969 - protein, 610 aa, Zea mays
MKAWEVMRERAYDFDLVLTEVAMPSLSGIQLLSRIAAAAECKNIPVIMMSSQDSIGTVLKCMQKGAVDFLVKPVRKNELGNLWQHVWRRHAMNCQTNGSENNAASNHVSTNVANGSKTGENNDEESDAQSFGNKRETEIKSAETLPDIRRDEMAGSSKKIELQNKSNDGVNTKVDASKDSDGAPSESEKNVRSKCLNGITSAKVAEQIMDNALRITDASSRRPTNLGKDLAMTEPAADRKCQSLVMENNAVKEKNPGEKSKSAVIGHADSYPSQFLETNLGKQQYRNGYKNQEFREKDIFNHSNSSAFSRYGNRRIESSGEIQFLPSRCIVGQEQHVHGKDPVFQPNGVLLPPNDHNTGESTRQARITLDSSMEGADIICSSSAREDAGASSSSHRKDSMSHPSYGFVPVPIPVGAMMPYHCGAILQPVYYPQGPLMHCNSSAINKATIHQTSGQSNYREDCGSGRPSQVDEHKQSEEKHQLHHSRQIHRESGQPVDMVRAHMDHANQSASCSRDICKGSGCTGSGEADTNANTTVALESGNESGIQNSDRSHREAALMKFRMKRKDRCFDKKVRYHSRKKLAEQRPRVKGQFVSQKLKAAMATEAETDS

SEQ ID NO: 2970 - protein, 610 aa, Sorghum bicolor
MKAWEVMRGRAYAFDLVLTEVAMPSLSGIQLLSRIVAADECKNIPVIMMSSQDSIGTVLKCMQKGAVDFLVKPVRKNELRNLWQHVWRRHAMNCQTNGSENNAASNHISANVANGSKTGENSDEESDAQSFGSKRETEIQSVEKLPDIRRDEDEVAGSSKKTESQNKSYDVRVNTKVDASKDSDGAPSGSEKNVHSKCLNGITSAKVAEQIMDNALRITDASSRRPSNLGKDLAMTEPEADRKCQSSVMENNAVTENNLGVKSKGAAICPADSCPSQFLETNLGKQHHLNGYKNQEFREKDIFNHSNSSAFSRYGNKRIEPSGEIQFFPSLCITGQEHVHGKDPVFQPNGVLLPPNEHNTGESTRQTRITLDSSPEGAAIMCSSSAREDAGVSSSSHRKDSMSHPSYGFIPVPIPVGPGMPYHYGAILQPVYYPQGPLMHCDSAGINKAAIQHGSGQSNYHEAPGKPSQDDEHKQSEENHQLHHSRQILRESGEPIEMARAHMDRANQSASCSQDICKGSGCTGSGEADINANTMVALESGNESGIQNGDRSRREAALMKFRMKRKDRCFEKKVRYHSRKKLAEQRPRVKGQFVSQKQKSATTTEAETDL

SEQ ID NO: 2971 - protein, 1221 aa, Zea mays
SSSHRRSAFSPGLAVLLSGDEAKISSQKSHLVSYHDEIGHQAVERTIEHIFDLPHKSVVRPPGPVDTGFVHSVVRNQARKFDLDWENCIRGYHRSVFIVDKGAGQRKVVLDDSSICGSFRNVRGPSLVESSAPFSSARANACVWKGKWMYEVTLETSGVQQLGWATLSCPFTDQKGVGDADDSYSFDGRRVTKWNNDPKPYGQPWAVGDVIGCCINLDAGEISFYRNGTSLGVAFDGIRSVEPKKGYYAAVSLSEGERCHLNFGSHPFRYPVDGFDPLEAPPRSWSFVTYLLRCLFRLLEVHNLEKSESAYFEKLRRVKKFAPLQELFGPISEGICAEIFSAIEASQGCLEYIAWGSLITLLLDVFRTREPHDFSCLDQVLDLFLRFPGCTSLFQELIVALSCMCKVAPLVLTECPYSGSYPFLALVCHLLRHKDVMCLWWKAEDFVFSFEGFLTRKIPNKQDLQCLVPSVWWPGSSEDEVSMTLTMTTLSDAIKKIEEMHRELCSLVICFIPPMSTPQPPGSVFRSFVQSLVLKARGGDHRMVVNGTFNNTVLVSLYTVILHLLSEGFSMDSAGSASSSKANFGNGVGFLHKGGKRKFPTQLFFRNDAYHSVIPRIGGPPSILMHHQFDAVENEVQWDEGCMNDEETRVTHTTAQKPCCCSVTDVAVGLRYKETAKYVPSTSKGSCKPMPERSPHVAAECNGRGLSDEIEDKPSTILISISSLQAFYFMSQQSQSISLLEETDRQIREKSCSEQVRRLKEARNSYHEDLVDCVRHCVWYRATLFSQWKQRGMYATCMWVVELLLVLSNSNSMFHYVPEFYVESLVDCFHALRRSDPPFVSPALFLMQGLASFVTLVVKHFDDTRIVNPDLKDLLLQSISVLVQYKEFMLVFENNREAINKMPRSLLSAFDNRSWIPVTNILSRFCKGSGFASYKNGESASSATFQVLLRETCIHEQELFFSFLNRLFNTLSWTMTEFSMSIREMQDKNQVADLQQRKCSVIFDISCSLARILEFCTREIPCAFLMGPDMNLRRLTELVVFILNHIISVADAEFFDMTLRRPGQHQEKTNRTMILAPLVGIILSLMECSSTSERRELNDVIAVFASMDCPATIHFGLQYLLSYNWSNVLRGDSSLAKLAQLKEFSHYFRRITASVDGEEEDHSLNAGDEDDDHTCCICYNCDSDATFQPCHHRSCFGCISRHLLNNQRCFFCNAVVTSVTR

SEQ ID NO: 2972 - protein, 988 aa, Sorghum bicolor
MAEGSSSHRRSAFSPGLAVLLSGDEAKISPQKSHLVSYHDEIGHQAVERTIEHIFDLPHKSVVRPPGPIDTGFVRSVLRNQARKFDIDWEKCIHGYQGSVLIVDKGAGQSKVVLDDSSICGSFRNIRGPLLVESSAPFSSARANACVWKGKWMYEVTLETSGVQQLGWATLSCPFTDQKGVGDADDSYSFDGRRVTKWNNDPKPYGQPWAVGDVIGCCINLDAGEISFYRNGTSLGVAFDGIRNVEPKKGYYAAISLSEGERCHLNFGSHPFRYPVDGFDPLEVPPRSWSFVTYLLRCLFRLLEVHNLEKSESAYFEKLRRVKKFAPLQELFRPISEGICAELFSAIEVSQGCLEYIAWGSLTTLLLDVFRTREPHDFSCLDQVLDLFLRFPGCTSLFQELIVALSCMCKAAPLVLTECPYSGSYPFLALVCHLLRHKDVMCLWWKAEDFAFSFEGFLTRKIPNKQDLQCLVPSVWWPGSSEDEVSMTLTMTTLSDAIKKIEEMHCELCSLVIRFIPPMSQPQPPGSVFRSFVQSLVLKARGGEHRMVVNGTFNNTVLVSLYTVILHLLSEGFSMDSAGSASSSKANCGNGVGFLHKGGKRKFPTQLLFRNDAYYSVIPRIGGPPSILMHHKFDAVENEVQWDEGCMNDEETRVTHTTVQKPCCCSVTDVAVGVRYKETAKYVPSTSKGPCKAMPERSAHVAAECNGRGLSDEIEDKPSTSAQSEIEYGYQALHISSVQAFYFMSQQSQSISLLEETDRQIREKSCSEQVRRLKEARNSYHEDLVDCVRHCVWYRAALFSQWKQRGMYATCMWVVELLLVLSNSNNIFHYVPEFYVESLVDCFHALRRSDPPFVSPALFLMQGLAPFVTLVVKHFDDTRIVNPDLKDLLLQSISVLVQYKEFMLVFENNREAINKMPRSLLSAFNNRSWIPVTNILSRFCKGSGFASSKNGESLSSATFQVLLRETCIHEQELFFSFLNRLFNTLSWT

SEQ ID NO: 2973 - protein, 440 aa, Sorghum bicolor
MQLPPMASGFATALYPVFLGGEQPHIQMSVPSASADLLFILHAGITSFVVSSADSVADITFLPLYVSIRLAVFLALLHYIWKVILQGLLQSTCRMFMGRSLPTRALPAAASKLTEARAANGTTRATETDYVLRLKAASESSLPEVRRIRMALPTASSKVASARAKLAEGAKTPANSKAKGRRLDDQEKRCKNGRLVPSLGCRTSPPLMPVGPDAEKKKCSWITANSEPLYVTFHDEEWGVPVHDDRMLFELLTLSLALGELTWPSILSKREEFSFCTREIFDGFNFALVSEFTEKKINLLRSNGIVLLSEQKIRAVVTNAKQMQKVVKDFGSFSNYCWSFVNHRPITNGFRYSRQVPTKTPKAEAISRDLMRRGFQCVGPTTIYSFMQVAGIVNDHLSCCFRFQACSQHKGSENNVRAEPALPDTRLGSLSSEDSDTREV

SEQ ID NO: 2974 - protein, 68 aa, Sorghum bicolor
MEGAVGQMVVPVLGIVAAAAVTFYTVSFMEMRDKSFEELDEKYSELDESGGRQRRSRRRAERDRKRAK

SEQ ID NO: 2975 - protein, 69 aa, Panicum virgatum
MEGAAAQMAVPVLGIIAAAAVTFYTVSFMQLRDKSFEELDEKYSEFDESGGRQRRARRRAERERKRRND

SEQ ID NO: 2976 - protein, 69 aa, Panicum virgatum
MEGAAAQMAVPVLGIIAAAAVTFYTVSFMQLRDKSFEELDEKYSEFDESGGRQRRARRRAERGRKRRND

SEQ ID NO: 2977 - protein, 750 aa, Zea mays
MAGVPSSLARLYFLLLPLATGCLLLLSAEAARLPLSLAPADAAADALLRLKAGINDSGGALGSWSPDTSPCGDGDGGGASWKGVMCNRDGVHGLQLEGMGLSGVLDLRALTSLPGPGLRTLSFMDNDFAGPLPDVKALSGLRALFLSGNKFSGVIPADAFAGMGSLKKVVLSNNDFTGPIPASLADAPRLLELQLNGNKFQGKIPDLKQDELTAVNLANNELEGEIPPSLKFTPPDMFAGNTKLCGPPLGVKCEAPPPPSASPSPSPPPSPKTPPPASVKEGTTPSQPAADTVASTGASSADDAKQDEGHKPVEGSTSTSFGVLAAFIGTLGIAGVAFVALRRRRGYKTKNFGPTASSARPSDPPRVEPHPPAAKAEASAAQAPPAAAGCVARAGGAARKVEQGRLTFVRDDRGRFFELQDLLKATAEVLGTANLGVCYCATLTTGHSVVVKRFKEMNRVGKEDFEEHMRRLGRLSHPNLLPLVAYYYRKEEKLLIHDYVPNRSLANLLHGGGDERGMKKAALHWAARLKIVKGVARALSYLYDELCMLTVPHGHLKSSNILLDGHYEPLLTDYALVPVMNQSHAAQLMVAFKSPERKQFGRSSKKSDVWCLGLLILEMLTGKPPTYDLPKAAGAVPSAESLSSPQKPGPAAGNGTDLVTVVGSTPEGEWLDTVVDPDLRGEEEEDKEEMVKLIRVGMACCESNVDSRWELKTAIDKIEELKAKERPAPDEEQAFYSTVNNEDFNDVAIN

SEQ ID NO: 2978 - protein, 741 aa, Sorghum bicolor
MARVPSLLLARLIFLLLLLLVADAARLPLSLAPGDDAAASDALLKLKAGIKDEDGALGSWSPDTSPCGGDGNGGGTTWMGVMCNKDGVHGLQLEGLGLSGKLDLRALKSLPGPGLRTLSFMDNEFAGPLPDVKELSGLRAVFLSGNKFSGVIPADAFAGMGSLKKVVLSNNEFTGPIPPSLADAPRLLELQLNDNKFQGKIPDLKQGELTQVNLANNELEGEIPASLKSMSPDMFAGNKKLCGPPLGAKCEAPPPPSPSPKAPPPSQSPKAPPATSAKEGTTPSVPAADIVGSTGASSADDAKQDEAQKPAEGSTSFGVLAAFLGALAIAGVAFVALRRRSGYKNKNFGPTASSARPSGPPRVEPHPPAAKAQASAAQATGAADGSVSRGGGAARKVEQGRLTFVREDRGRFFELQDLLKATAEVLGTANLGVCYCATLTSGHSVVVKRFKEMNRVGREDFEEHMRRLGRLSHPNLLPLVAYYYRKEEKLLIHDYVPNRSLANLLHGGGEGCGMKKAAVHWAARLKIVKGVARALSYLYDELGMLTVPHGHLKSSNILLDGHYEPLLTDYALVPVMNQSHAAQLMVAFKAPERKQFGRSSKKSDVWCLGLLILEMLTGKQPSYDLHKPSGESSSSSPPQKPGPAAGNTTDLVTVVASTPEGEWLDTVVDPDLRGEEEEDKQEMVKLIRVGMACCETNVDSRWELRTAIDRIEELKAKERPDEEQAFYTTVNEEEYSDVAIN

SEQ ID NO: 2979 - protein, 499 aa, Oryza sativa
MSDHRTHASDCHPVASQPDVQCLVCTRPFTLDAQVTDTFEALAICRDCKMTVLNDDERDEITSTYRQNTRRRQISRTASIDFLEDAFLQEFSQLIDLARRQGRETDIDSSSVAPQHASFNSTPSQSQRWHASDDESDGLNYVDSVFGEIESAISLGDYGGDSDTSIEEHSVMTRRRISIQLDNDSYMNTDTDIDPMNARLDQWDSDDQEDVEESGFDEIVNTMTQHQQQSHDIQLSGLSEDESEDGVWNWSVSVRQRANVTNLLDDMEEPEMRTTFVGNPDDYVDARQFEMLLEQFAEDNDSRRGAPPAATSFIENLPSVIISASHQTNGDVICPVCKDPIPTRARAKQLPCMHLYHSSCILPWLSSRNTCPVCRYELPTDDAEYERSKQATTNVRDIQVVEEISDEQEVQVTRQMAAGVIEETNTSEHNVRVDEQPNSARRRSGWLFIAAAPVVSLIGFALVLCFTNPARSGRRQLYCRSPSATEVHVDTKKSWWSMF

SEQ ID NO: 2980 - protein, 659 aa, Hordeum vulgare
MLRVEEALAAVLSAAAACRAAPSAVPLLDALGLVLAEDARAPDPLPPFRASVKDGYAVVAADGPGEYPVIAEARAGDDALGVVVTPGTVAYVTTGGPIPDGADAVVQVEDTEQVAAAPDGSKRVRISARVPEGHDIRSVGCDIEKDSIVLKSGENIGPAEIGLLATVGVTTVKAYRRPTIAVFSTGDELVEPATATLNRGQIRDSNRAMLLAAAIQQKCKVVDLGIAKDTEESLMEHMDAALHSDADIILTSGGVSMGDRDLVKPCLAKMGKIHFEKIRMKPGKPLTFAEITSNDTTKPSKTALAFGLPGNPVSCMVCFNVFVVPAIRLVSGWSNPHLQRVHVRISHPLRADPHRMEFHRAVIRWVLDDGSGRPGYVAESTGHQASSRLLSMKSANALLEVQSSGQILAAGASVQAILISDITSPPLDKLPAASSPLSSHLVSSAKSALAGAPQAAASQNAEVKVAILTVSDTVSSGAGPDRSGPRAVSVVNSSSEKLGGAVVVATAVVPDEVDKIKEILVKWSDIDRVNLILTLGGTGFTPRDVTPEATKCVIEKEAPGLAFVMIQESLKVTPFAMLSRAACGIRGSTLIINMPGNPNAVAECMEALLPALKHAMKQLKGDKREKNPRHVPHAEAAPVDQWERSFRAASSGGGCSCDP

SEQ ID NO: 2981 - protein, 664 aa, Brachypodium distachyon
MLQVEDALAAVLSAAAGRRAAASASAAVPLLDALGLVLAEDVRAPDPLPPFRASVKDGYAVVASDGPGEYAVIAEARAGDDALGVVVTPGTVAYVTTGGPIPDGADAVVQVEDTEQVAAPPDGTKRVRISVRVAEGHDIRNVGCDIEKDLVVLKSGEHLGPAEIGLLATVGVTAVKAYRRPTIAVFSTGDELVQPDTATLSRGQIRDSNRAMLLAAAIQHKCKVVDLGIAKDTEVSLKELMDAALRSDADIILTSGGVSMGDRDLVKPCLAKMGKIYFDKIQMKPGKPLTFAEISTDDTARSSKTALAFGLPGNPVSCMVCFNLFVVPAIRLLSGWSNPHLQRVHVRLSHPLRADSHRPEFHRAVIRWVLDDGSGRPGYVAESTGQQASSRLLSMKSANALLEVPASGQTLAAGVSIQAIVIADITSPPLYKQPAATTTSLLPTHFVSSAKSMSTDVSQVAASQNAEVKVAILTVSDTVSSGAGPDRSGPRAVSVVNSSSEKLGGAVVVATAVVPDEVDQIKDVLVKWSDVDRVNLILTLGGTGFTPRDVTPEATKCVIEKEAPGLAFVMIQESLKVTPFAMLSRAASGIRGSTLIINMPGNPNAVAECMEALLPALKHAIKQLKGDKREKNPRHVPHADAAPVDQWERSFKAASSGGGCSCDP

SEQ ID NO: 2982 - protein, 657 aa, Zea mays
MLQVEEALAAVLSAAAGHAEPHAVPLQGALGLVLAEDVCAPDPLPPFRASIKDGYAVVASDGPGEYPVVTESRAGDDALGVVVVPGTVAYVTTGGPVPDGADAVVQVEDTEQLPGGADGSKRVRILARASQRQDIRSVGCDIEKDSIVLKSGEHIGPAEIGLLATVGVTTVKVYPRPTIAVFSTGDELVQPATATLSRGQIRDSNRAMLLACAIQQKCKVVDLGIAEDTEESLKEHMDAALRSNADIIITSGGVSMGDRDLVKPCLAKMGKIHFEKIQMKPGKPLTFAEITTQDTPKPSKTVLAFGLPGNPVSCIVCFNLFVVPAIRLLSGWSNPHLQRVHVRISHPLRADPHRTEFHRAAIRWVLDDGSGRPGFVAESTGHQASSRLLSMKSANALLEIPSTGQILAAGTSIQAILISDIITSSDKLPTPSNPYPSRGPSAKSISADVSQIASPQDAEVKVAILTVSDTVSSGAGPDRSGPRAVSVVNSSSEKLGGATVVATAVVPDEVDKIKGILVQWSDIDHVNLILTLGGTGFTPRDVTPEATKMVIQKEAPGLTFVMLQESLKITPFAMLSRATAGIRGSTLIINMPGNPNAVAECLEALLPALKHALKQIKGDKREKHPRHTPHAAAAPVDQWERSFRAASSGSGGCSCDP

SEQ ID NO: 2983 - protein, 660 aa, Sorghum bicolor
MLQVEEALAAVLSAAAGHAAPRAVPLHDALGLVLAEDVRAPDPLPPFRASIKDGYAVVASDGPGEYPVVTESRAGDDALGVVVAPGTVAYVTTGGPIPDGADAVVQVEDTEQVTSGADGAKRVRILARAAEGQDIRNVGCDIEKDSLVLNSGEHIGPAEIGLLATVGVTTVKVYPRPTIAIFSTGDELVQPATATLSRGQIRDSNRAMLLAAAIQQKCKVVDLGIAEDTEESLKEHMDAALRSDADIIITSGGVSMGDRDLVKPCLAKMGKIHFEKIQMKPGKPLTFAEITTQDTSKPSKTVLAFGLPGNPVSCMVCFNLFVVPAIRLLSGWSNPNLQRVHVRLSHPLRADSHRTEFHRAVIRWVLDDGSGRPGFVAESTGHQASSRLLSMKSANALLEVPSTGQILAAGTSIQAILISDIITSPLDKLPAPSNPHPSHFGPSAKSISTDVSQIASPQDAEVKVAILTVSDTVSSGAGPDRSGPRAVSIVNSSSEKLGGATVVATSVVPDEVDKIKGILIQWSDIDHVNLILTLGGTGFTPRDVTPEATKSVIQKEAPGLTFVMLQESLKITPFAMLSRATAGIRGSTLIINMPGNPNAVAECMEALLPALKHALKQIKGDKREKHPRHTPHAAAAPVDQWERSFRAASAGSGRGCSCDP

SEQ ID NO: 2984 - protein, 659 aa, Triticum aestivum
  misc_feature (128)..(128): Xaa can be any naturally occurring amino acid
  misc_feature (131)..(131): Xaa can be any naturally occurring amino acid
MLRVEEALAAVLSAAAACRAAPSAVPLLDALGLVLAEDVRAPDPLPPFRASVKDGYAVVAADGPGEYPVIAEARAGDDALGVVVTPGTVAYVTTGGPIPDGADAVVQVEDTEQVAAAPDGSKRVRISXRVXEGHDIRSVGCDIEKDYIVLKSGENIGPAEIGLLATVGVTTVKAYRRPTIAVFSTGDELVQPATATLNRGQIRDSNRAMLLAAAIQQKCKVVDLGIAKDTEESLMEHMDAALRSDADIILTSGGVSMGDRDLVKPCLAKMGKIHFEKIRMKPGKPLTFAEITSNDPTKPSKTALAFGLPGNPVSCMVCFNLFVVPAIRLVSGWSNPHLERVHVRISHPLRADPHRMEFHRAVIRWVLDDGSGRPGYVAESTGQQASSRLLSMKSANALLEVQSSEQILAAGASVQAILISDITSPPLDKLPAASSPLSSHLVSSAKGALADAPQVAASQNAEVKVAILTVSDTVSSGAGPDRSGPRAVSVVNSSSEKLGGAVVVATAVVPDEVDKIKEILVKWSDIDRVNLILTLGGTGFTPRDVTPEATKSVIQKEAPGLAFVMIQESLKVTPFAMLSRAACGIRGSTLIINMPGNPNAVAECMEALLPALKHAMKQLKGDKREKNPRHVPHAEAAPVDQWERSFRAASSGGGCSCDP

SEQ ID NO: 2985 - protein, 2144 aa, Brachypodium distachyon
MAAALAWRFNGTNGSSHGGADLERHVDKVQDSEPPTPVSVMRMGKNRVNMEDEETLSSVAQCIEQLRQSSSSSQEKESSLKQLLDLIQARDTAFGAVGSHPQAVPILVSLLRSGSSGVKMLAATVLGSLCKEEELRVKVLLGGCIPPLLALLRSKSAESQTAAAKTIYSVSQGGIRDHVGSKIFSTENVVPVLWEQLKVSLKNESLVDSLLTGALKNLSKNTEGFWSATVQCGGVDILIKLVGSGQTNTLANVCNLLGALMMEDSSVCSKVLSGETTKQLLKLLGPGSETSIRAEAAGALKSFSAQSKEARRQIANSNGIPALINATIAPSKEFMQGESAQALQENAMCALANISGGLSYVISSLGESLESCSSPAQIADTLGALASALMIYDTNAESTSASDPLVIEKTLMKQFKPKAPFLVQERVIEALASLYSNPVLCKTLADSDAKRLLVGLITMAGTEVQDDLMTSLFSLCKKDCDLWQALQGREGVQLLISLLGLSSEQQQECAVALLALLSKENDECKWAITAAGGIPPLVQILETGSPKAKEDSATIIGNLCNHSEDIRACVESADAVPALLWLLKNGSDNGKEIASKTLNHLIHKSDTGTISQLSALLTSEQPESKVYVLDALKSLLSVAPLNDILHEGSAANDAVETMIKILSSPKEETQAKSASALAGLFHCRKDLRETHIAVKTLWSVMKLIDTQSDRLLMESSCCLAAIFLSVKQNKEVAAVGRDALATLVSLASSTVLEVAEQATRALANLFLDHDMCAQVSFEEILFPLTRVLREGSIDGRTHGAAAIARLLQCRPVNQPISDTINRSGAVLALAGLLEAANGDATATSEVLDALVLLSRSKVSSGHTKAPWAALAENPHTILPLVSCVADAAPSLQDKAIEVLSRLCSKQHDVVGGLVSEIPGCISSVARRVIGSNILKVKVGGCALLVCAAKEHCQKQIEILCDSSLYIQLIHSLVGMIQATNFASENGNGESISDIKISRQSKENNSDGDMVCHTAIISGNMIPLWLLAVFTRHDNKTRAEILEAGAVEMLTEKISQNAFLYVGEEDNTAWVCALLLALLFQEREINRSNSASHSIPVLSNLLRSDEPAYRYFAAQALASLVSNGSRGTLLAVANSGAATGLISLLGCADVDIADLLELSEEFMLVQNPDEITLERLFRVDDIRVGSTSRKSIPLLVDLLKPIPERPGAPFLALGLLTQLAVDCTQNMLLMAEVGVLEALTKYLSLSPQDATEEATTELLGILFSSTEIRQHESALGAVNQLVAVLRLGGRNSRYSAAKALENLFCADHVRSSESARQAIQPLVEVLSTGMEREQHAAISALVRLLCDNPSRALAVADVEMNAVDVLCRILSSDCSAELQGDAAELCGVLFANTRIRSTMAAARCVEPLVSLLVSEANPAQLSVVRALDKLLDDEQLAELVAAHGAVIPLVGLLLGKNYMLHEAVARALVKLGKDRPACKLEMVKAGVIESILDILHDAPDFLCMALAEMLRILTNNASIAKGPSAAKVVQPLFSLLSKADTGPEGQYSTLQVLVNILEHPECRADYNLTARQTIEPVITLLNSSPPAVQQLAAELLSHLLLEEHLHKDTVAEQSITPLIQVLSSGLPNLQQRAIKALANLALAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRSHQCEEAAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTEPATLCIPHLVTSLKTGSEATQEAALDSLYLLRQAWSACPAEVFKAQSVAASEAIPLLQYLIQSGPPRFQEKAEMLLQCLPGTLTVTIKRGNNLRQSVGNASAFCKLTLGNNPPRLTKIVSTGAAPEWDEAFAWAFDSPPKGQKLHISCKNNSKFGKKSFGKVTIQIDRVVMLGSVAGEYTLLPESKSGPNRNLEIEFQWSNK

SEQ ID NO: 2986 - protein, 1867 aa, Zea mays
VRICRNRVNVEDEETLSSVAQCIEQLRQSSSSSQEKESSLKQLLDLVQTRDTAFGAVGSHSQAVPILVSLLRSGPSGVKMLAATVLGSLCKEEELRVKVLLGGCIPPLLALLRSKSAESQTAAAKTIYAVSQGGIRDHVGSKIFSTENVVPVLWEQLKISLKNESLVDGLLTGALKNLSKNTEGFWSATVQCGGVDILIKLVSSGQTNTLANTCYLLGSLMMEDSSVCSKVLSGETTKQLLKLLGPGNETSIRAEAAGALKFLSAQSKEARRQIANSNGIPSLINATIAPSKEFMQGESAQALQENAMCALANISGGLSYVISSLGESLESCSSPAQIADTLGALASALMIYDTNAESISASNPVDIEKTLLKQFKPKVPFLVQERIIEALASLYGNPVLCKTLADSDAKRLLVGLITMAATEVQDDLTKSLFALCKKDCDLWQALQGREGVQLLISLLGLSSEQQQECAVALLALLSKENDESKWAITAAGGIPPLVQILETGSSKAKEDSATILGNLCNHSEDIRACVQSADAVPALLWLLKNGSDNGKEIASKTLNHLIHKSDTGTISQLSALLTSDQPESKVYVLDALKSLLSVAPLNDILHEGSAANDAVETMIKILSSPKEETQATSATALAGLFHCRKDLRETHIAVKTLWSVMKLLDMQSNKILTGASCCLAAVFLSIKENKEVAAIGRDALNPLVSLANSSVIEVAEQATRALANLFLDQELSLQVPFEEILFRVTRVLREGTIDGRTHAAAAIARLLQCRTINQPLSDTVNRSGSVLALAGLLEAANGEAAATSEVLDALVLLSRSKASSGHTKAPWAILAENPHTILPLVSCIADAAASLQDKAIEVVSRLCSDLHDVVGGLVSETPGCMSSITRRIIGSNILKVKVGGCALLVCAAKEYCQKQIEVLNDASLYIQLIHSLIGMIHMANTQAENVSSESISDIRISRHSKENNSDGETLCCTAVISGNMIPLWLLAIFSRHDSKTRAELLEMGAVEMLIEKISQNAFQYVGEEDNTSWVCSLLLTLLFQERETIRSNSALHSIPVLSNLLRSDEPAYRYFAAQALSSLVCNGSRGTLLAVANSGAAIGLISLLGCADVDIADLLELSEEFMLVPNPDQIALERLFRVDDIRVGATSRKSIPLLVDLLKPIPERPGAPFLALGLLTQLAVDCPPNMLLMAEAGILEALTKYLSLSPQDATEEATTELLGILFSSPEIRHHESALGVVNQLVAVLRLGGRNSRYSAAKALESLFCADHVRNSESTRQAIQPLVEILSTGMEREQHAAISALVRLLSDNPSRALAVADVEMNAVDVMCRILSSDCSVELKGNAAELCCVLFTNTRIRSTMAAARCVEPLVGLLVSEANPAQLSVVRALDRLLDDEQLAELVAANGAVIPLVGLLYGKNYMLHEAVARALVKLGKDRPACKLEMVKAGVIESILDILHDAPDFLCIALAEMLRILTNNATIAKGPSSAKVVQPLFSLLSKADMGPEGQYSTLQVLVNILEHPECRADYNLTPRQTIEPVITLLNSSPPAVQQLAAELLSHLLLEDHLQKDTVTEQAITPLIQVLSSGLPNLQQRAIKALANLAIAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRSHQCEETAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVIT

SEQ ID NO: 2987 - protein, 1942 aa, Sorghum bicolor
MAAALAWRFNGTNGGAHGSGDLERHVDKVQDSEPPTPMSVMKMGKNRVNVEDEETLSSVAQCIEQLRQSSSSSQEKESSLKQLLDLVQTRDTAFGAVGSHSQAVPILVSLLRSGPSGVKMLAATVLGSLCKEEELRVKVLLGGCIPPLLALLRSKSAESQTAAAKTIYAVSQGGIRDHVGSKIFSTENVVPVLWEQLKISLKNESLVDGLLTGALKNLSKNTEGFWSATVQCGGVDILIKLVSSGQTNTLANACYLLGSLMMEDSSVCSKVLSGETTKQLLKLLGPGNETSIRAEAAGALKFLSAQSKEARRQIANSNGIPALINATIAPSKEFMQGESAQALQENAMCALANISGGLSYVISSLGESLESCSSPAQIADTLGALASALMIYDTNAESTSASDPVDIEKTLLKQFKPKVPFLVQERIIEALASLYGNPVLCKTLADSDAKRLLVGLITMAATEVQEDLTKSLFALCKKDCDLWQALQGREGVQLLISLLGLSSEQQQECAVALLALLSKENDESKWAITAAGGIPPLVQILETGSPKAKEDSATILGNLCNHSEDIRACVESADAVPALLWLLKNGSDNGKEIASKTLNHLIHKSDTGTISQLSALLTSEQPESKVYVLDALKSLLSVAPVNDILHEGSAANDAVETMIKILSSPKEETQATSATALAGLFHCRKDLRETHIAVKTLWSVMKLLDMQSNKILMGASCCLAAVFLSIKQNKEVAAIGRDALTPLVSLANSSVIEVAEQATRALANLFLDQELSLQVSFEEILFRVTRVLREGTIDGRTHAAAAIARLLQCRTINQPLSDTINRSGSVLALAGLLEAANGEAAATSEVLDALVLLSRSKASSGHTKAPWAVLAENPHTILPLVSCIADAAASLQDKAIEVVSRLCSDQHDVVGGLVSETPGCISSITRRIIGSNMLKVKVGGCALLVCAAKENCQKQIEVLNDASLYIQLIHSLIGMIHMANMPAENVSSESISDIRISRHSKENNSDGETVCRTAVISGNMIPLWLLAVFSRHDSKTRAELLEAGAVEMLTEKISQNAFQYVGEEDSTSWVCSLLLALLFQEREIIRSNSALHSIPVLSNLLRSDEPAYRYFAAQALSSLVCNGSRGTLLAVANSGAAIGLISLLGCADVDIADLLELSEEFMLVPNPDQIALERLFRVDDIRVGATSRKSIPLLVDLLKPIPERPGAPFLALGLLTQLAVDCPPNMQLMAEAGILEALTKYLSLSPQDATEEATTELLGILFSSPEIRHHESALGVVNQLVAVLRLGGRNSRYSAAKALESLFFADHVRNSESARQAIQPLVEILSTGMEREQHAAISALVRLLSDNPSRALAVADVEMNAVDVMCRILSSDCSVELKGDAAELCCVLFTNTRIRSTMAAARCVEPLVGLLVSEANPAQLSVVRALDRLLDDEQLAELVAAHGAVIPLVGLLYGKNYMLHEAVARALVKLGKDRPACKLEMVKAGVIESILDILHDAPDFLCIALSEMLRILTNNATIAKGPSAAKVVQPLFSLLSKADMGPEGQYSTLQVLVNILEHPECRADYNLTPRQTIEPVITLLNSSPPAVQQLAAELLSHLLLEDHLQKDTTTEQAITPLIQVLSSGLPNLQQRAIKALANLAIAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRSHQCEETAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTE

SEQ ID NO: 2988 - protein, 643 aa, Brachypodium distachyon
MQFAQCSSFNGFIVAPRFMHIGKSSRKLAHAALANSKPRVSGTQNIGPSYASGLAYRSRAFLHGTVHNGPSTSFVLGRAKESLYWSPGARNLSVLSSCSRNAFHSQLAWKQLTAMGSRAPRASPLLSRAACAITLAATRSKVVPYLVAFIAGEIMLAEKTSAEGEYLPIRDNIYMRAQDSRIYVTSLIFSAVEMVIIIFRSIYLAMLFTPSVLMAPFADNLGSKYRKTWLRLVHRTLEKAGPAFIKWGQWAATRPDLFANDLCTELSKLHTKAPAHSFAYTKKTVEKAFGRKLSDIFENFEEEPVASGSVAQVHRASLRFRHPGKKTKRETVAVKVRHPGVGDSIRRDFSIINTVAKISRYIPALNWLRLDESVQQFAVFMMSQVDLAREAAHLSRFIYNFRMWKDVSFPTPLYPLVHPAVLVESYEHGESVSHYVDDHDGHERIKSALAHIGTHALLKMLLVDNFVHADMHPGNILVRVVQPKNSNNTLLKSRPHVVFLDVGMTAELSSNDRVNLLEFFKAVARRDGRTAAESTLKLSKQQNCPNPKVFIEEVERAFSFWGTPEGDVIHPADCMHQLLEQVRRHKVNIDGNVCTVMVTTLVLEGWQRKLDPDYNVMKTLQTLLFKEDWAKSLQYTIEGLMAP

SEQ ID NO: 2989 - protein, 430 aa, Zea mays
MAPFAETLGSKYRKTWLRLVHRTLELAGPAFIKWGQWAATRPDLFPSDLCTELSKLHTKAPAHSFTYTKKTVEKAFGRKLSDIFENFEEDPVASGSVAQVHRAVLRFRYPNRQTKRVTVAVKVRHPGVGDSIRRDFNIINAVAKISRYIPTLNWLRLDESVQQFAVFMMSQVDLAREAAHLSRFIYNFRRWKDVSFPRPLYPLVHPAVLVETYEHGESVSHYVDDLEGHDRIKSALAHIGTHALLKMLLVDNFVHADMHPGNILVRVAQPKNSNNTLKKSRPHVVFLDVGMTAELSSNDRVNLLEFFKAVARRDGRTAAESTLKLSKQQNCPNPKAFIEEVERSFSFWGTAEGDAIHPAECMHQLLEQVRCHKVNIDGNVCTVMVTTLVLEGWQRKLDPDYNVMKTLQTLLFKEDWAKSLQYTIQGLMAP

SEQ ID NO: 2990 - protein, 430 aa, Sorghum bicolor
MAPFAETLGSKYRKTWLRLVHRTLELAGPAFIKWGQWAATRPDLFPSDLCTELSKLHTKAPAHSFKYTKKTVEKAFGRKLSDIFENFEENPVASGSVAQVHRAVLRFRYPNQQTKRVTVAVKVRHPGVGDSIRRDFNIINAVAKISRYIPTLNWLRLDESVQQFAVFMMSQVDLAREAAHLSRFIYNFRRWKDVSFPRPLYPLVHPAVLVETYEHGESVSHYVDDLEGHDRIKSALAHIGTHALLKMLLVDNFVHADMHPGNILVRVVQPKNSNNTLIKSRPHVVFLDVGMTAELSSNDRVNLLEFFKAVARRDGRTAAESTLKLSKQQNCPNPSAFIEEVERSFSFWGTAEGDVVHPAECMHQLLEQVRRHKVNIDGNVCTVMVTTLVLEGWQRKLDPDYNVMKTLQTLLFKEDWAKSLQYTIQGLMAP

SEQ ID NO: 2991 - protein, 970 aa, Brachypodium distachyon
MHPLLLVLVHLVFLAEAKGAGRGAGSVAALNDDVLGLIVFKADVVDPEGRLATWSEDDERACAWAGVTCDPRTSRVSGLSLDGFGLSGKLGRGLLRLESLQSLSLSRNNFSGDLPADLARLPDLQSLDLSSNAFSGAVPDGFFGKCHSLRDVSLANNAFSGGIPDVGGCATLASLNMSSNRLAGTLPGGIWSLNALRTLDLSGNAITGDLPVGISKMFNLRALNLRSNRLTGSLPDDIGDCPLLRSVNLRSNSLSGNLPESLRRLSSCTDLDLSSNELTGTVPTWIGEMASLEMLDLSGNKFSGEIPESIGGLMSLRELRLSGNGFTGGLPESIGRCRSLVHVDVSWNSLTGSLPAWIFSSGVQWVSVSDNTLSGEVLVPVNASSVIQGVDLSSNAFSGPIPSEISQLLTLQSLNISWNSLSGSIPASIMEMKSLELLDLSANRLNGRIPATIGGKSLKVLRLGKNSLAGEIPVQIGDCSALASLDLSHNGLTGAIPATIANLTNLQTADLSRNKLTGGLPKQLSNLAHLIRFNVSHNQLSGDLPPGSFFDTIPFSSVSDNPGLCGSKLNSSCPGVLPKPIVLNPDSSSNPLAQTEPVLEGLRHKKTILSISALVAIGAAVLIAVGIITITVLNLRVRSPASHSAPVLELSDGYLSQSPTTDVNAGKLVMFGGGNSEFSASTHALLNKDCELGRGGFGTVYKTTLRDGQPVAIKKLTVSSLVKSQDEFEREVKMLGKLRHHNLVALKGYYWTPSLQLLIYEFVSGGNLHKLLHELSTVSCLSWKERFDIVLGIARSLAHLHRHDIIHYNLKSSNIMLNGSGEAKVGDYGLAKLLPMLDRYVLSSKVQSALGYMAPEFTCRTVKITDKCDVYGFGVLVLEVMTGKTPVEYMEDDVIVLCDVVRAALDEGKVEECVDERLCGKFPLEEAVPIMKLGLVCTSQVPSNRPDMSEVVNILELIRCPPDSPETELG

SEQ ID NO: 2992 - protein, 971 aa, Oryza sativa
MRALVVLVGLACLAFVAEAKGGGAASAAALDDDVLGLIVFKADVVDPEGRLATWSEDDERPCAWAGVTCDPLTGRVAGLSLAGFGLSGKLGRGLLRLESLQSLSLSGNNFSGDLPADLARLPDLQSLDLSANAFSGAIPDGFFGHCRNLRDVSLANNAFSGDVPRDVGACATLASLNLSSNRLAGALPSDIWSLNALRTLDLSGNAITGDLPVGVSRMFNLRSLNLRSNRLAGSLPDDIGDCPLLRSVDLGSNNISGNLPESLRRLSTCTYLDLSSNALTGNVPTWVGEMASLETLDLSGNKFSGEIPGSIGGLMSLKELRLSGNGFTGGLPESIGGCKSLVHVDVSWNSLTGTLPSWVFASGVQWVSVSDNTLSGEVFVPVNASSMVRGVDLSSNAFSGMIPSEISQVITLQSLNMSWNSLSGSIPPSIVQMKSLEVLDLTANRLNGSIPATVGGESLRELRLAKNSLTGEIPAQIGNLSALASLDLSHNNLTGAIPATIANITNLQTVDLSRNKLTGGLPKQLSDLPHLVRFNISHNQLSGDLPPGSFFDTIPLSSVSDNPGLCGAKLNSSCPGVLPKPIVLNPDSSSDPLSQPEPTPNGLRHKKTILSISALVAIGAAVLITVGVITITVLNLRVRTPGSHSAAELELSDGYLSQSPTTDVNSGKLVMFGGGNPEFSASTHALLNKDCELGRGGFGTVYKTTLRDGQPVAIKKLTVSSLVKSQDEFEREVKMLGKLRHRNLVALKGYYWTPSLQLLIYEFVSGGNLHKQLHESSTANCLSWKERFDIVLGIARSLAHLHRHDIIHYNLKSSNILLDGSGDAKVGDYGLAKLLPMLDRYVLSSKVQSALGYMAPEFACRTVKITEKCDVYGFGVLALEILTGRTPVQYMEDDVIVLCDVVRAALDEGKVEECVDERLCGKFPLEEAVPIMKLGLVCTSQVPSNRPDMSEVVNILELIRCPQDSPETELG

SEQ ID NO: 2993 - protein, 972 aa, Sorghum bicolor
MRPLALLVLAHLAALVAAAEAKGGAAGAGLGDDVLGLIVFKADVSDPDGRLATWSEDDERPCAWGGVTCDARTGRVSALSLAGFGLSGKLGRGLLRLEALQSLSLARNNLSGDVPAELARLPALQTLDLSANAFAGAIPEGLFGRCRSLRDVSLAGNAFSGGIPRDVAACATLASLNLSSNLLAGALPSDIWSLNALRTLDISGNAVTGDLPIGISRMFNLRALNLRGNRLTGSLPDDIGDCPLLRSLDLGSNSLSGDLPESLRRLSTCTYLDLSSNEFTGSVPTWFGEMGSLEILDLSGNKFSGEIPGSIGGLMSLRELRLSGNGFTGALPESIGGCKSLMHVDVSWNSLTGALPSWVLGSGVQWVSVSQNTLSGEVKVPANASSVLQGVDLSNNAFSGVIPSEISKLQNLHSLNMSWNSMSGSIPASILEMKSLEVLDLTANRLNGCIPASTGGESLQELRLGKNFLTGNIPAQIGNCSSLASLDLSHNNLTGGIPETISNLTNLEIVDLSQNKLTGVLPKQLSNLPHLLQFNVSHNQLSGDLPPGSFFDTIPLSSVSDNPGLCGAKLNSSCPGVLPKPIVLNPNTSSDPISPTEPVPDGGRHHKKTILSISALVAIGAAALIAVGVITITVLNLRVRAPGSHSGAALELSDGYLSQSPTTDMNAGKLVMFGGGNPEFSASTHALLNKDCELGRGGFGTVYKTTLRDGQPVAIKKLTVSSLVKSQVEFEREVKMLGKLRHRNLVALKGYYWTPSLQLLIYEFVSGGNLHKQLHESSTTNCLSWKERFDIVLGIARSLAHLHRHDIIHYNLKSSNILLDGSGEAKVGDYGLAKLLPMLDRYVLSSKVQSALGYMAPEFACRTVKITEKCDVYGFGVLILEILTGRTPVEYMEDDVIVLCDVVRAALDEGKVEECVDERLCGKFPLEEAVPIMKLGLVCTSQVPSNRPDMNEVVNILELIRCPQDSPETELG

SEQ ID NO: 2994 - protein, 234 aa, Sorghum bicolor
MAWRGPLGAGDAGDSGLELSLGLPAYFAKPSSGLDVAAGEESGEASAFAHQAANGSNGSKARVRPAPAAPVVGWPPVRSFRRNLASSSSSRPSPPSSSGHHKVQDGGAHKGGLFVKINMDGVPIGRKVDLTAYGGYADLSAAVGKLFRGLLAAQRDPAATAGGEAAAEEEVQEPVIGGDYTLVYEDDEGDRVLVGDVPWEMFVATAKRLRVLKSSDVPASSLRAGGRKRAAADC

SEQ ID NO: 2995 - protein, 999 aa, Triticum aestivum
  misc_feature (145)..(145): Xaa can be any naturally occurring amino acid
  misc_feature (228)..(228): Xaa can be any naturally occurring amino acid
  misc_feature (279)..(279): Xaa can be any naturally occurring amino acid
HASAPRQERRLDKKKPKKKRKNTEHHTNFRPPTYRSKPRISIRKNTSRNRRSRDPSPSGSHSAAARLPLRRDVETLVGMAEVSAAAALVPEGVLHRRIEFHLARRPHSAAAVGGGGFQMETLNPDAAGGASSAAVGAARGEAEAXRPEKAEALGLDPELTVARIYLGRIGAGLQNLGNTCYLNSVLQCLTYTEPFAAYLQSGRHKSSCRTAGFCALCALQNHVKTALXSTGKIVTPSQIVKNLRCISRSFRNSRQEDAHELMVNLLESMHKCCLPSGVXSESASAYEKSLVHRIFGGRLRSQVKCTRCSHCSNTFDPFLDLSLDIGKATTLVRALQNFTEDELLDGGQKQYQCERCRQKVVAKKRFTIDQAPNVLTVHLKRFSPFRPREKIDKKVDFQPVLDLKPFMSDSKGADYKYSLYGVLVHAGWSTQSGHYYCFVRTSSGMWHNLDDNQVRQVREADVLKQKAYMLFYVRDRIGNTLGRKDNSTPNLPVNNMIPGKISSINGEMEAKSSGLTSPYANKKLQSTSNAHSSVSSMTLVDHCSTNAGKAETAAALQNSVLPAAQKALGPQNDGATLSTKSKQVASSSHKETSSSDQLASSNQTMAKMSLQEPKTGGALAKLGNNTSIASSMVSGPAGLSETDKQTSCSQTCSKPSSNLVGTITGFTAQTFQTKDAVLSNGVIPSTSGGDPVSSEKMKDLTGSLKQDDHIVKALTTSKKEKTILPGLEQVDVGKQISSQVSTKVVPGDSCNGRMTKRVDSKSKKLVRYPLMKLWLRPRQLSLKQQKKKHKKTKKRVKDTASVDCSGDNSSEQQTSTSATVPPKTAGSTSRKRKHAHASASSENGTQVFKDSQQVVGASSAGAGDHNMDARNGKSQTSANQANSRNNVDAKRGAASQQVVIRTEDLRAEVTVPCWDDVAVPNSETSEYKSSGKKSIGYVLDEWDEEYDRGKAKKVRKAKEDDNDDGMNPFQAEANYVSARKTKQNSYKSKPWDKPARPSR

SEQ ID NO: 2996 - protein, 293 aa, Brachypodium distachyon
MAPLLFLLLAALALSPTFDAAAGGFYDQARVTQLSWRPRAFLYSGFLSHAECDHLVKLAKGRLQKSMVADNDSGKSVMSQVRTSSGTFLNKHEDEIISGIEKRVAAWTFLPEENAESIQVLHYEVGQKYDAHFDYFHDKNNQKLGGHRVATVLMYLTDVKKGGETVFPNAEGRHLQHKDETWSECARSGLAVKPRKGDALLFFSLHINATTDPSSLHGSCPVIEGEKWSATKWIHVRSFDNPPIVRMDVRCSDDNELCSKWAAVGECYRNPKYMIGTKDTLGFCRKSCGICDA

SEQ ID NO: 2997 - protein, 299 aa, Oryza sativa
MAPLRTLVIFLLLLLALVPALSRPDGGGGGFYDPARVTQLSWRPRAFLYSGFLSHDECDHLVNLAKGRMEKSMVADNDSGKSIMSQVRTSSGTFLSKHEDDIVSGIEKRVAAWTFLPEENAESIQILHYELGQKYDAHFDYFHDKNNLKRGGHRVATVLMYLTDVKKGGETVFPNAAGRHLQLKDETWSDCARSGLAVKPKKGDALLFFSLHVNATTDPASLHGSCPVIEGEKWSATKWIHVRSFDNPPDVSLDLPCSDENERCTRWAAVGECYRNPKYMVGTKDSLGFCRKSCGVCDA

SEQ ID NO: 2998 - protein, 296 aa, Triticum aestivum
  misc_feature (40)..(40): Xaa can be any naturally occurring amino acid
PIMPPLLLAALALALALSHAAAGGGAGFYDPARVTQISWXPRAFLYSGFLSHAECDHLIKLAKGRLEKSMVADNESGKSVMSQVRTSSGTFLSKREDEIISGIEKRVAAWTFLPEENAESMQVLHYEVGQKYDAHFDYFSDKKNVKRGGHRVATVLMYLTDVKKGGETVFPIAEGRDLQHKDETWSERARHGLAVKPRKGDALLFFSLHVNATTDPSSLHASCPVVEGEKWSATKWIHVRSFDNPPDVMTDARCSDDNEQCPRWAALGECYKNAKYMVGTKDTLGSCRKSCGVCDA

SEQ ID NO: 2999 - protein, 477 aa, Brachypodium distachyon
MATPTVVLLPVWGAGHLMSMLDAGKRLLARSRGALSLTVLVMQAPAENYRSEVAGHIRREEASGLDIRFHHLPTVELPTDYVGIEEFISRFVQLHAPHVKAAISGLACPVAALVVDFFATTLFDVSRELAVPAYVYFTASAAAYALFLRLPALQEEVTCEFEELDGMVDVPGLPPVPPSSLPSPLMDKKNPNYTWFVYHGRRFMEANGVMINTAAALEQSVLAAIADGRCTPGIPAPTVYPVGPVISFNPPAEQGGHECLRWLDTQPPASVVLLCFGSGGFSTAPQAHEIAHGLERSGHRFLWVLRGPPAAGAQQPADANLEELLPEGFLERTKGKGLVWPTKAPQKEILAHAAVGGFVTHGGWNSVLESLWFGVPMVPWPLYAEQHFNAFTLVAYMGVAVAMEVDRKRKNFVRASDLERAVVALMGDSDEGRKAREKATEMKAACRSAVEEGGSSYSALGSLAEEMIKGVNQRSPH

SEQ ID NO: 3000 - protein, 492 aa, Brachypodium distachyon
MATPPTLVLLPEWGAGHLMSMLESCKRVLLSGGRAFSITLLVMRPPTAAATSEVEAHVRREAASGLDIRIHRLPAVEPPADAAGVEEFIARYIELHAPGVRDAVAGMSCPVAALVLDLFAAPMVDVAQDLGVPSYVFMSSTGAMLALMLHLPVLHEAVTVEFEEVEGGVVHVPGLPPIPHEWMPCPVVDKKSPNYTWFVRLGERFMDATGIIANTADELEPGPLAAIAEGRAVPGRPAPPVYPIGPVLSLGSSSSKKESSSGPPHACVAWLDAQPRASVVLLCFGSMGWFEAAQVVEICAALERCGAHRFLWVLRGPPGADTGAGAPDGSEHPTDADLDELLPEGFLERTAGRVLVWPTWAPQKEILAHAAVGGFVTHCGWNSVLESLWHGVPMAPWPLYAEQHLNAFELVADMGVAVPLKVDRKRDNFVEAAELERAVESLMGGGEEGRKAREKAAVMRDVCRKAVGKGGSSEAALQRLSEVLHEGALPKV

SEQ ID NO: 3001 - protein, 480 aa, Zea mays
MATPALVLLPEWGSGHLMSMLESCKRVLLSSSGGKAFSITLLVMRPPTAEATSEVEAHVRREAACGLDIRFHRLPAVEAPTDAVGVEEFIARYIGLHAPHVRDAVAAMACPVAALVLDLFAAPLVDVARGLGVPSYVFMSSTGAMLALMLHLPVLHESVPAVDFDEMEGDVPLPGLPPVPPDSMPCPVADKRSPNYACFVRLGDRFMDATGVIANTADELEPGPLAAVARGRCVPGRPAPPVYPIGPVLSLGGRSPSHECVAWLDAQPPGSVAFLCFGSMGWFDPPQVAEITAALERCGHRFLWVLRGPPSDASGSEHPTDANLDELLPEGFLERTGGKGLVWPTWAPQKEILAHPAVGGFVTHGGWNSVLESLWHGVPMAPWPLYAEQHLNAFQLVADMGVAVPLKVDRKRGNFVVAAELERAVRSLMDADGEQGRRAREKAARMKAVCRKAVEEGGSSHAALQRLAEALHDGAVIPKK

SEQ ID NO: 3002 - protein, 496 aa, Oryza sativa
MATLAPALVLLPEWGSGHLMSMLESCKRVLLAGAGGGREFSITLLVMRPPTDEAGSEVEAHVRREAASGLDIRFHRLPAVDPPADAAGVEEFIARYIHLHAPHVRDAVAGMGRPVAALVLDMFAAPMVDVARDLGVPSYVFMSSTGAMLALMLHLPVLHDRVAVEFHEVDGEVDVPGLPPLPPASMPCPVVDKKSPNYTWFVRLGDRFMDATGIIANTADELEPGPLAAIADGRCVPGRAAPPVYPIGPVLSLGGNDKRDSSEPPHECIAWLDGQPPASVVFLCFGSMGWFEAAQVVEITAALERSGHRFLWVLRGPPPAAESGTGAPDGSEHPTDANLDELLPEGFLERTKGRGMVWPTWAPQKEILAHPAIGGFVTHGGWNSVLESLWHGVPMAPWPLYAEQHLNAFELVRDMGVAVPLGVDRERDNFVEAAELERAVRSLMDDASEEGKKAREKAAEMKAVCRSAVAAGGGSSHAALQRLSEALHQGAALPKN

SEQ ID NO: 3003 - protein, 487 aa, Sorghum bicolor
MAAPALVLLPEWGTGHLMSMLESCKRVLLSGGGGKAFTITLLVMRPPTAEATSEVEAHVRREAASGLDIRFHRLPAVEAPSDAAGVEEFIARYIALHAPHVRDAVAAMSCPVAALVLDIFAAPLVDVARGLGVPSYVFMSSTAALLALMLHLPVLHESVPVEFDEVEGEVQVPGLPPVPPESMPCPVVDKKSPNYAWFVRLGDRFMDATGIIANTADELEPGPLAAVAGGRCVPGRPAPPVYPIGPVLSLGDRSPSHECVAWLDAQPPGSVVFLCFGSLGWFDPSQVVEITAALERCGHRFLWVLRGPPSDASGSGAGAPDGAEHPTDANLDELLPEGFLERTKGKGLVWPTWAPQKDILAHPAVGGFVTHGGWNSVLESLWHGVPVVPWPLYAEQHLNALELVADMGVAVPLKVDRKRDNFVEAAELERAVRSLMDADGEQGRRAREKTADMKAVCRKAVEEGGSSHAALQRLAEALHHGAVIAKK

SEQ ID NO: 3004 - protein, 151 aa, Triticum aestivum
IRHEFLQMTEGKGLVWPTWVPQKDILAHPAVGGFVTHAGWNSVLESLWHGLPMAPWPLYAEQHLNAFELVADMGVAVPLKVDRKRDNFVEAANLERAVKCLMGEEGRKARERAAEMRDVCRNAVNKGGSSDAALQRLSEALHHGSVLPPTM

SEQ ID NO: 3005 - protein, 186 aa, Triticum aestivum
SARGFLWVLRGPPSSKSGAGAPDGSEHPTDASLEELLPEGFLRRTEGKGLVWPTWAPQKEILAHPAVGGFVTHGGWNSVLESLWHGIPMAPWPLYAEQHLNAFELVADMGVAVPLKVDRKRDNFVEAAELERAVRCLMGEEGRKAREKAAEMRDVCRKAVEKGGSSDAALQRLSEALHDGAVRPTI

SEQ ID NO: 3006 - protein, 502 aa, Brachypodium distachyon
MASCDDDFGLLGDDAHPAPQPSAQPPPPQQAQTFCFVDAPATGSGSGPFVPAQEEGNHSSERGKASHHSKRRRERAEEFSDGGEYCSYISSSAGGRKGRGGGGGGSSDYRKDREEWTDGAISSLLDAYTERFEQLNRGNLRGRDWEDVAAAVTDGQGKGGAGKSVEQCKNKIDNLKKRYKVECTRNGGAGAASVSHWPWYRQMEQIIGNSSSPGTSKPLAPTNDEKPRQLLQNANKRYPSSGTGPPTMVPCSRLTPLSNPKWKRVLLKIGGTALAGEAPHNVDPKVIMLIAREVQVACRHGVEVAIVMGARNIFCGDNWVAATGTDRASTHPVGMMAAVMNAVLLQASLEKIGVETRVQTALMMQEVAEPYIRRRAMRHLQKGRVVIFGGIGACIGNPLFTTDTAAALRASEINADVVLKGIAGDDEYGCPPRSNSNALFEHISFRELAARGTSSMDMTAITCCEENNIPVVIFNMLEPGNISRAICGDQVGTLVDQSGRIT

SEQ ID NO: 3007 - protein, 519 aa, Zea mays
MASCDDDFVLLGDDAHQPATPPPPAPTAQQPAPPPPPPPQASHPFSFTDAVAGAAAGAGSFAQAQEESNHHAERGKPAHHAKRGRERAEEFSSDGGEYCSYINSSGSGGGGKKGRGGGGSSSVSDYRKDREEWTDGAISSLLDAYTDRFEQLNRGNLRGRDWEDVAGAVTDGQGKTTGAKSVEQCKNKIDNLKKRYKVECQRLSSSGGGAISHWPWFKKMEQIVGNSASPASSKLLTAAEDEKPRQQQQHSSKRYPLSCTGPPTGVGSSRTNPLSNPRWKRVLLKIGGTALCGAAHQNVDPKVIMLIAREVQVACHHGVEVAIVVGGRNIFCGDNWVAATGTDRASTYPIGMMASVMNSVLLQASLEKIGVETRVQTALMMQEVAEPYIRRRAIRHLEKGRVVIFGGIGVGIGNPLFTTDTAAALRASEINADVVLKGIVGDDEYGCPPRSNSNASFEHISFRELAARGITKMDMTAVTCCEENNIPVVIFNMLEPGNISRAICGDQIGTLVDQSGRIT

SEQ ID NO: 3008 - protein, 197 aa, Pennisetum glaucum
AVVGGRNIFCGDNWVAAAGTDRASTYPIGMMASVMNSVLLQASLEKIGVETRVQTALMIQEVAEPYVRRRAIRHLEKGRVVIFGGIGAGIGNPLFTTDTAAALRASEINADVVLKGIVSDDEYGCPPRSNSNTPFEHISFREFAARGFSRMDMTAVTCCEENNIPVVIFNMLEPGNISRAICGDQIGTLVDQSGRIT

SEQ ID NO: 3009 - protein, 530 aa, Oryza sativa
MASCDDDFGLLGDGPVPEEEAAAAAASSQAAPPPPQQQAQAFCFGDAASVAGAGAGVGPFAPMGQEEGNHSAERGKAAAAAAHHSKRGRDRAEEFSDGGEYCSYLNSGGGGGGAGKKGRGGGGGGGGGVAAGSSEYRKDREEWTDGAISSLLDSYTDRFEQLNRGNLRGRDWEDVAAAVTDGQGKSSGGKSVEQCKNKIDNLKKRYKVECQRLAGSGASAVSHWPWFKKMEQIVGNSSSPASSKALVASDDDNKPRQPQQHSSKRHAPSGSSTPTFGGSSRLAPPSNPKWKRVLLKIGGTALAGAPPQNVDPKVIMLIAREVQVACRHGVEVSIVVGGRNIFCGDTWVSATGTDRASTYSIGMMASVMNAVLLQASLEKIGVETRVQTALMMQEVAEPYIRRRAIRHLEKGRVVIFAGIGAGIGNPLFTTDTAAALRASEINADVVLKGTAGDDDYGCPPRGNNNPPFEHISFRELAARGFSRMDMTAITCCQENNIPVVIFNMLEPGNISKAICGDQVGTLVDQSGRIT

SEQ ID NO: 3010 - protein, 519 aa, Sorghum bicolor
MASCDDDFGLLGDDAHQPATPPPAPPIAQQPAPPPSQQAAHPFSFTVAPAGVAAGAGSFAQVQEDSNHHAESGKPAQHAKRGRERAEEFSSDGGEYCSYINSSGSGGGGKKGCGGGGISSVRDLYRKDREEWTDGAISSLLDAYTDRFEQLNRGHLRGRDWEDVASVVTDGKGKTTGGKSVEQCKNKIDNLKKRYKVECQRLTSSGGGAVSHWPWFKKMEQIVGDSMSPASSKPLAAAEDVKPRQQQQQHGSKRYPLSSTGPPTGVGSSRTNPLSNPRWKRVLLKIGGTALCGEAPQNVDPKVIMLIAREVQVACHHGVEVAIVLGGRNIFCGDNWVAATGTDRASTYPIGMMASVMNSVLLQASLEKIGVETRVQTALMMQEVAEPYIRRRAIRHLEKGRVVIFGGIGAGTGNPLFTTDTAAALRASEINADVVLKGIVGDDESGCPPRSNSNASFEHISFRELAARGITKMDMTAVTCCEENNIPVVIFNMLEPGNISRAICGDQIGTLVDQSGRIT

SEQ ID NO: 3011 - protein, 519 aa, Saccharum officinarum
  misc_feature (138)..(138): Xaa can be any naturally occurring amino acid
  misc_feature (161)..(161): Xaa can be any naturally occurring amino acid
MASCDDDFGLLGDDAHQPATPPPAPPTAQQPAPPPSQQAAHPFSFTVAPAGAAAGAGSFAQVQEDSNHHAERGKPAQHAKRGRERAEEFSSDGGEYCSYINSSGSGGGGKKGRGGGGISSVHDLYRKDREEWTDGAIXSLLDAYTDRFEQLNRGHLRGRDXEDVAAVVTDGQGKTTGGKSVEQCKNKIDNLKKRYKVECQRLTSSGGGATSHWPWFKKLEQIVGDSVSPASSKPLAAAEDVKPRQQQQQHGSKRYPLSSTGPPSGVGSSRTNPLSNPRWKRVLLKIGGTALRGAAPQNVDPKVIMLIAREVQVACHQGVEVAIVVGGRNIFCGDNWVAATGTDRASTYPIGMMASVMNSVLLQASLEKIGVETRVQTALMMQEVAEPYIRRRAIRHLEKGRVVIFGGIGAGTGNPLFTTDTAAALRASEINADVVLKGIVGDDESGCPPRSNSNASFEHISFRELAARGITKMDMTAVTCCEENNIPVVIFNMLEPGNISRAICGDQIGTLVDQSGRIT

SEQ ID NO: 3012 - protein, 147 aa, Panicum virgatum
TRVQTALMIQEVAEPYVRRRAIRHLEKGRVVIFGGIGAGIGNPLFTTDTAAALRASEINADVVLKGIVGDDEYGCPPRGNTNTPFEHISFRELAARGFSRMDMTAVTCCEENNIPVVIFNMLEPGNISKAICGDQIGTLVDQSGRIT

SEQ ID NO: 3013 - protein, 300 aa, Panicum virgatum
MEQIVGNSASPASSKAPVVVEDEKPRQQQQHASKRCPLSSAGPLTVVGSSRANSLSNPRWKRVLLKIGGTALAGAAPQNVDPKIIMLIAREVQVACHHGVEVAIVVGGRNIFCGDNWVAATGTDRASTYPIRMMASVMNSVLLQASLEKIGVETRVQTALMIQEVAEPYVRRRAIRHLEKGRVVIFGGIGAGIGNPLFTTDTAAALRASEINADVVLKGIVGDDEYGCPPRGNSNTPFEHISFRELAARGFSRMDMTAVTCCEENNIPVVIFNMLEPGNISRAICGDQIGTLVDQSGRIT

SEQ ID NO: 3014 - protein, 387 aa, Triticum aestivum
TRPDGAISSLLDAYMDRFEQLNRGNLRGRDWEDVAAAVTDGQGKSSGGKSVEQCKNKIDNLKKRYKVECQRIAGSASVSLWPWYKQMEQIMGNSPSPGTPKPPPATNDEKPRQQQQHSNKRYPSSGTGHATTMVPYSRSTPLSNPKWKRVLLKIGGTALAGEAPHNVDPKVIMLIAREVQVACRHGVEVAILMGGRNVFCADSWVAATGTDRASTHPIGMMAAVMNAVLLQASLEKIGVETRVQTALMMQEVAEPYIRRRAIRHLEKGRVVIFGGTGAGTGNPLFTTDTAAALRASEINADVVLKGVIGDDEYGCPPRSNGSAPFEHISFRELAARGTSKMDMTAITCCEENNIPVVIFNMLEPGNMSRAICGDQVGTLVDQSGRIT

SEQ ID NO: 3015 - protein, 489 aa, Brachypodium distachyon
MAGTSLPASERPPHAVMIPYPAQGHVTPMLKLAKLLHARGFHVTFVNNEFNQRRLQRAQGGGPGALDGAPGFRFATIDDGLPRSDRDAQQDVPSLCRSTMTTCLPRFKALIARLNEDADGAAPPVTCVVGDSTMTFALRAAKELGLRCATLWTASACGFMGYAHYKDLVQRGLFPLKDEAQLSNGYLDTTVDWIPGLPKDLRLRDLPSFVRSTDPDDIMFNFFVHETAGMAQASGVVINTFDELDAPLLGAMSKLLPPVYTVGPLHLTVRNNVPAESPVAGIDSSLWIQQQDAPLRWLDGRAPGSVVYVNFGSITVMSNEHLLEFAWGLANTGYAFLWNVRPDLVRGDEAALPPEFSAATAGRSMLTTWCPQEKVLEHEAVGVFLTHSGWNSTLESICGGVPMVCWPFFAEQQTNCRFKRTEWGIGVEVPDEVRRDEVEAMIREAMEGEKGRDMRRRVLELRDSALASAKPGGRSMCNVDRLIQEVLLA

SEQ ID NO: 3016 - protein, 455 aa, Brachypodium distachyon
LLHARGFHVTFVNNEYNHRRLLRSQGAEMLNSVPGFRFEAIADGLPPSDNEDATQDITSLCYSTMTTCFPRFKELILRLNKDAEDSGGALPPVTCVIGDSVMSFALGVARELGIRCATLWTASACGFMAYYHYKDLAQRGLVPLKDEQQLSNGYLDTTIDWIPGVPKDLRLRDFPSFVRTTDPNDIMFNFFIHETAGMSQASAVVINTFDELDAPLLDAMSKLLPKVYTVGPLQLTVRNNIPEESPIVSIGSNLWKEQDAPLRWLDSRPAGSVVYVNFGSITVMSKEHLLEFAWGLANTGYSFLWNVRPDLVKGDEAALPPEFFKLTEGRSMLSTWCPQEKVLEHEAVGVFLTHSGWNSTLESISAGVPMVCWPFFAEQQTNCRYKCTEWGIGMEIDDNVRRVEVEALIREAMEGQKGQEMKRRVLDLKKSAVASAQPGGRSMSNVDKFIEEVLL

SEQ ID NO: 3017 - protein, 332 aa, Brachypodium distachyon
MSKQRNYPLEIDDESSVLGADEAQLSNGYLDTTVDWIPGLPKDLRLRDLPSFVRSTDPDDIMFNFFVHETAGMAQASGVVINTFDELDAPLLGAMSKLLPPVYTVGPLHLTVRNNVPAESPVAGIDSSLWIQQQDAPLRWLDGRAPGSVVYVNFGSITVMSNEHLLEFAWGLANTGYAFLWNVRPDLVRGDEAALPPEFSAATAGRSMLTTWCPQEKVLEHEAVGVFLTHSGWNSTLESICGGVPMVCWPFFAEQQTNCRFKRTEWGIGVEVPDEVRRDEVEAMIREAMEGEKGRDMRRRVLELRDSALASAKPGGRSMCNVDRLIQEVLLA

SEQ ID NO: 3018 - protein, 205 aa, Leymus cinereus x Leymus triticoides
NLWKEQDAPLRWLDGWPPRSVVYVNFGSITVMSKEHMLEFAWGLANTGYAFLWNVRPDLVKGDDEVALPPEFFAATEGRSMLSTWCPQEKVLEHEAVGVFLTHSGWNSSLEGICGGVPMVCWPFFAEQQTNCRYKCTEWGIGMEIGDDVRRTEVEALIREAMEGEKGREMRRRVLELRESAVASARPGGRSMRNVDRLIHEVLLA

SEQ ID NO: 3019 - protein, 489 aa, Zea mays; identical to SEQ ID NO: 382

SEQ ID NO: 3020 - protein, 497 aa, Sorghum bicolor
MGSLPTEERERRQQQPPHVVMVPYPAQGHVTPMLQLAKLLHTRGFHVTFVNNEFNHRRHLRARGPGALDGAPGFRFVAIDDGLPRSDADATQDVPALCYSTMTTCLPRFKDLVARTNAEAEAQGRPAVTCVVADSVMTFALRGARELGLRCATLWTASACGFIGYYYYRHLVERGIVPLQNEAQLTDGYLDDTVVDWIPDGAAPKDLRLRDFPSFVRTTDPDDIMLNYFIHEVAGMSQASAVVINTFDELDATPLHAMAKLLSRPVYTVGPLPLTVRNNVPADSPVAAIASNLWKEEDAPLRWLHGRAPRSVVYVNFGSITVMSNEQLAEFAWGLANTGYAFLWNVRPDLVKGGGGGGGLPSEFAAATEGRSMLSTWCPQAAVLEHDAVGVFLTHSGWNSTLESICGGVPMVCWPFFAEQQTNCRYKRTEWGIGMEIGSDVRRGEVEALIREAMEGEKGREMRRRVTELKESAVAAARPDGRSMRNVDRLIDEVLLA

SEQ ID NO: 3021 - protein, 227 aa, Panicum virgatum
PLPLTVRNNVPAGSPVAAIGSNLWKEQDAPLRWLDGRPPRSVVYVNFGSITVMSKEELAEFAWGLAGTGYAFLWNVRPDLVKGGGDSAGLPPEFAAATEGRSMLSTWCPQAAVLEHDAVGVFLTHSGWNSTLESICGGVPMVCWPFFAEQQTNCRFKCTEWGIGMEIGGDVKRVEVEALIREAMEGKKGREMRRRVAELRDSAVAAASPGGRSMRNVDRLIDEVLLA

SEQ ID NO: 3022 - protein, 307 aa, Triticum aestivum
MDTWTRSSTGYRRCPRTCGLGVDLPSYLRTVDPDDIMFNFFIHEVPAMSQASAVVINTWDELDAPLLDAMSKLLPPIYTAGPLHLTARNNVPEESPVSGIGSNLWKEQDAPLRWLDGRPPRSVVHVNFGSTTVMSKEHMLEFAWGLANTGYAFLWNVRPDLVKGDVKAALPPEFYAATEGRSMLSTWCPQQEVLEHEAVGVFLTHSGWNSSLEGICGGVPMVCWPFFAEQQTNCRFKCTEWGIGMEIGDDVRRTEVEAMIREAMEGEQGREMRRRVLELRQSAVASSRRDGRSMRNVDRLIKEVLLA

SEQ ID NO: 3023 - protein, 338 aa, Pseudoroegneria spicata
VAEESICCEIRMLEEKLNIIAFGEGREDLMASRSQALKFLHEIGWLLQRSHTRATSSKAPQQHRHRVVGIPAARFRWLLSFAVDQEWCGVLKLLLDTLFQGNIDVASPVEFVLGESLVFAAVNKRSKPLVAFLLRYTTKSAPVGSGAVATPARFLFTPDMTGPSDITPLHVAATITNAAAVLDALTDDPQQLGIKTWKNARDATGYTPEDYARRRGHTSYIQMVQNKINSRLLAAHVSVSMTSTGIAEEHADAGRPKSTDQTVFDVEKSPPGCRQCVQLQHIAYRPCPNRFLSNRPAVLSLVAIAAVCVCVGLIMQSPPVVRGLPGPFLWNRIRWGPT

SEQ ID NO: 3024 - protein, 310 aa, Triticum aestivum
  misc_feature (262)..(262): Xaa can be any naturally occurring amino acid
PDLMASRSRALKFLHEIGWLLQRSHTRATSSKAPQQHHAVGFSAARFRWLLSFAVDQEWCGVVKMLLDTLFQGNIDVASPVDFVLGESLVFAAVNKRSKPLVACLLRYTTKSAPVGSGAVATPARFLFTPDMTGSSDITPLHVAATITNAAAVLDALTDDPQQLGIKTWKNARDATGYTPEDYARRRGHTSYIKMVENKINSRLPAAHVSVAMTTTGIAEKHTDDGRPRSTEQTVFDVEKSPPGCRQCVQLQHIAYRPCPNXFLSNRLAVLSLVAIAAVCVCVGLIMQSPPVIRGLPGPFLWNHIRWGPT

SEQ ID NO: 3025 - protein, 550 aa, Brachypodium distachyon
MPAAALAFASTFAPPQPWVPRRPHPRHARLRLPPPRSGGGDNNKPTTSWVSPDWLTSLSRSLVGRGGGGGDGSGIPVASAKLDDVRDLLGGALFLPLFKWFREEGPVYRLAAGPRDFVIVSDPAVAKHVLRGYGTRYEKGLVAEVSEFLFGSGFAIAEGALWTVRRRAVVPSLHKRFISVMVEKVFCKCAERLVEKLETYALSSEPVNMEARFSQMTLDVIGLSLFNYNFDSLTSDSPVIDAVYTALKEAEARSTDLLPYWQIDLLRKIVPRQIKAEKAVNIIRNTVEELITKCKTIVDAENEQIEGDEYVNEADPSILRFLLASREEVNSSQLRDDLLSMLVAGHETTGSVLTWTVYLLSKDPAALRRAQDEVDRVLQGRLPRYEDVKELKYLMRCINESMRLYPHPPVLIRRAIVDDVLPGNYKVKAGQDIMISVYNIHRSPEVWDRADEFVPERFDLEGPVPNESNTDFRFVPFSGGPRKCVGDQFALLEAIVALAVVLQKIDIQLVADQEINMTTGATIHTTNGLYMNVSLRRVEQEPELALSDSR

SEQ ID NO: 3026 - protein, 342 aa, Zea mays
MEARFSQLTLDVIGLSLFNYNFDSLTTDSPVIDAVYTALKEAELRSTDLLPYWKVGFLCKIIPRQIKAENAVMIIRNTVEELIMKCKEIVEAENEQIEGEEYVNEGDPSILRFLLASRDEVSSVQLRDDLLSMLVAGHETTGSVLTWTIYLLSKDPTALRRAQDEVDRVLQGRLPKYEDVKELKYLMRCINESMRLYPHPPVLLRRAIVDDVLPGNYKVKAGQDIMISVYNIHRSPEVWDRADEFIPERFDLEGPVPNESNTDFRFIPFSGGPRKCVGDQFALLEAIVALAVVLQKMDMQLVPDQKINMTTGATIHTTSGLYMNVSLRKVQQEAELALSESK

SEQ ID NO: 3027 - protein, 561 aa, Oryza sativa
MAAAAAAAVPCVPFLCPPPPPLVSPRLRRGHVRLRLRPPRSSGGGGGGGAGGDEPPITTSWVSPDWLTALSRSVATRLGGGDDSGIPVASAKLDDVRDLLGGALFLPLFKWFREEGPVYRLAAGPRDLVVVSDPAVARHVLRGYGSRYEKGLVAEVSEFLFGSGFAIAEGALWTVRRRSVVPSLHKRFLSVMVDRVFCKCAERLVEKLETSALSGKPVNMEARFSQMTLDVIGLSLFNYNFDSLTSDSPVIDAVYTALKEAELRSTDLLPYWKIDLLCKIVPRQIKAEKAVNIIRNTVEDLITKCKKIVDAENEQIEGEEYVNEADPSILRFLLASREEVTSVQLRDDLLSMLVAGHETTGSVLTWTIYLLSKDPAALRRAQAEVDRVLQGRLPRYEDLKELKYLMRCINESMRLYPHPPVLIRRAIVDDVLPGNYKIKAGQDIMISVYNIHRSPEVWDRADDFIPERFDLEGPVPNETNTEYRFIPFSGGPRKCVGDQFALLEAIVALAVVLQKMDIELVPDQKINMTTGATIHTTNGLYMNVSLRKVDREPDFALSGSR

SEQ ID NO: 3028 - protein, 555 aa, Sorghum bicolor
MPATAFASASVAASPSPWSPRPPPRRGHVRVRAPPPRSGSSAGGGGGDEPSTATPWASPDWLTSLSRAVGRSGGGDDSGIPVASAKLDDVRDLLGGALFLPLFKWFREEGPVYRLAAGPQDFVIVSDPAVARHVLRGYGSRYAKGLVAEVSEFLFGSGFAIAEGDLWTVRRRAVVPSLHKRFLSIIVEKVFCKCAERLIEKLEPYASSGEPVNMEARFSQLTLDVIGLSLFNYNFDSLTTDSPVIDAVYTALKEAELRSTDLLPYWKIDFLCKIIPRQIKAENAVRIIRNTVEELIMKCKEIVEAENEQIEGEEYVNEGDPSILRFLLASRDEVSSVQLRDDLLSMLVAGHETTGSVLTWTIYLLSKDPTALRRAQDEVDRVLQGRLPKYEDVKELKYLMRCINESMRLYPHPPVLLRRAIVDDVLPGNYKVKAGQDIMISVYNIHRSPEVWDRADEFIPERFDLEGPVPNESNTDYRFIPFSGGPRKCVGDQFALLEAIVALAVVLQKIDIQLVPDQKINMTTGATIHTTNGLYMNVSLRKVQQEAELALSESK

SEQ ID NO: 3029 - protein, 550 aa, Triticum aestivum
MPAAAFASAFASPPPPWAPRPPPRHASLRLPPPRSSSNNSGGGGGDKPTTSWVSPDWLTSLSRSVLGRGNDDSGIPVASAKLDDVQDLLGGALFLPLFKWFREEGPVYRLAAGPRDFVIVSDPAVAKHVLRGYGTRYEKGLVAEVSEFLFGSGFAIAEGALWTVRRRAVVPSLHKRFLSVMVDKVFCKCAERLVEKLETYALSGEPVNMEARFSQMTLDVIGLSLFNYNFDSLTSDSPVIDAVYTALKEAEARSTDLLPYWQIDLLCKIVPRQIKAEKAVNTIRNTVEELITKCKAIVDAENEQIEGEEYVNEADPSILRFLLASREEVSSLQLRDDLLSMLVAGHETTGSVLTWTIYLLSKGPVALRKAQEEVDRVLQGRLPRYEDVKELKYLMRCINESMRLYPHPPVLIRRALVDDVLPGNYKVKTGQDIMISVYNIHRSPEVWDRADEFIPERFDLEGPIPNESNTDFRFIPFSGGPRKCVGDQFALLEAIVALAIVIQKMDIQLVADQKISMTTGATIHTTNGLYMNVSLRKVEQEADLALSPSG

SEQ ID NO: 3030 - protein, 568 aa, Brachypodium distachyon
MGRSRGVPNPGDDDTNHRSKRRRVASSGDATDSLSAACGGAGDGKKALYHCNYCNKDLSGKIRFKCSKCPDFDLCVECFSVGAEVQPHRSNHPYRVMDNLSFPLICPDWNADEEILLLEGIEMYGLGNWAEVAEHVGTKGKAQCIEHYTTAYMNSPCYPLPDMSHVNGKNRKELLAMAKVQGESKKGISVLPGDSTPKDESPFSPSRVKVEDAPGEGPAGRSPSHIAGGANKKASTAGHFKDSANLAKMEDGHMDRSIGVKKPRYSADEGPSLTELSGYNAKRHEFDPEYDNDAEQALAEMEFKETDSETDRELKLRVLRIYLSRLDERKRRKEFILERNLLYPNPLEKDLTNEDKEVYHRYKVFMRFLSKEEHEALVRSVIEERKIRRRIQELQECRSAGCRTLAEAKIHIEQKRRKEYEANAHKAKESGQLIPTTKVVHKTNRPMKLESDGNLDPKKSNATVDSGGRDSPKATGHTVAKQWDDWDIVGLPGAELLSASEKLLCCQNRLLPSHYLRMQEVLMQEMFKGSVVKREDAHVLFKVDPAKVDTVYDMVMKKLGSNEEAPTV

SEQ ID NO: 3031 - protein, 565 aa, Zea mays
MGRSRGVQNSGDDDTVHRSKRRRVASGGDATDSVSAGIGGAGEGGGKKALYHCNYCNKDISGKIRIKCSKCPDFDLCVECFSVGAEVTPHRSNHPYKVMDNLSFPLICPDWNADEEILLLEGIEMYGLGNWLEVAEHVGTKSKLQCIDHYTTAYMNSPCYPLPDMSHVNGKNRKELLAMAKVQGESKKGTSLLPGELTPKAESPFSPSRVKVEDALGEGLAGRSPSHIAVGANKKASNVGHIKDGSNVSKVEDGHVDRSVGVKKPRYSADEGPSLTELSGYNAKRHEFDPEYDNDAEQALAEMEFKETDSETDRELKLRVLRIYLSRLDERKRRKEFILERNLLFPNPLEKDLTNEDREVYHRYKVFMRFLSKEEHEALVRSVIEERKIRRRIQELQECRSAGCRTLAEAKIHIEQKRKKEYELNAQKAKESNHLIANTKLVQKMNRPMKIESDGNLDPKKGGVGLDSPKTTGLTSVKQWDDWDIVGLPGAELLSASEKLLCCQNRLLPSHYLRMQEVLMQEIFKGSVLKKEDAHVLFKVDPTKVDSVYDMVTKKLGNHVELPTV

SEQ ID NO: 3032 - protein, 565 aa, Zea mays
MGRSRGVLSSGDDDTGHRSKRRRVSSGGDATDSISASIGGAGEGGGKKALYHCNYCNKDISGKIRIKCSKCPDFDLCVECFSVGAEVTPHRSNHPYKVMDNLSFPLICPDWNADEEILLLEGIEMYGLGNWLEVAEHVGTKSKLQCIDHYTSAYMNSPCYPLPDMSHVNGKNRKELLAMAKVQGESKKGTLLLPGELTPKVESQFSPSRVKVEDALGEGPAGRSPSHMAVGANKKASNVGHIKDGATVSKVEDVHVDRSVGVKKPRYSADEGPSLTELSGYNAKRHEFDPEYDNDAEQALAEMEFKETDSETDRELKLRVLRIYLSRLDERKRRKEFILERNLLFPNPLEKDLTSEDRELYHRYKVFMRFLSKEEHEALVRSVIEERKIRRRIQELQECRSAGCRTLAEAKIHIEQKRKKEYELNAQKAKDSSQLNANNKSVQKMNRPMKIESDGNLDPKKGGAGLDSPKTTGPTSVKQWDDWDIVGLPGAELLSASEKLLCCQNRLLPSHYLRMQEVLMQEIFKGSVLKKEDAHVLFKVDPTKVDSVYDMVSKKLGNHEEAPTV

SEQ ID NO: 3033 - protein, 390 aa, Pennisetum glaucum
MAKVQGDSKKGTTLLSGELTPKAESPFSPSRVKMEEALGDGTAGRSPSHMAGAGANKKASNAGQNKDGANISKVEVPDGHVDRSIGVKKPRYSADEGPSLTELSGYNAKRHEFDPEYDNDAEQALAEMEFKETDSETDRELKLRVLRIYLSRLDERKRRKEFILERNLLFPNPLEKDLTNEDKEVYHRYKVFMRFLSKEEHEALIRSVIEERKIRRRIQELQECRSAGCRTLAEAKIHIEQKRKREYELNAQKTKESGQLIPNNKSVQKMNRPVKIESDGNLDPKKGGAGLDSPKTTGLTSVKQWDDWDIVGLPGAELLSASEKLLCCQNRLLPSHYLRMQEVLMQEIFKGSVHKKEDAHVLFKVDPTKVDTVYDMVTKKLGNHEEAPTV

SEQ ID NO: 3034 - protein, 202 aa, Pseudoroegneria spicata
  misc_feature (2)..(2): Xaa can be any naturally occurring amino acid
AXPFQEEHEALVRSVIEERKIRRRIQELQECRSAGCRTLAEAKIHIEQKRRKEYEANALKAKESGQLISNTKSGHKTNRPMKLETDGSLDLKKGSAILDAGGRDSPKTTGPTSAKQWDDWDIVGLPGAELLSSSEKLLCCQNRLLPSYYLRMQEVLMQEMFKGNVVKKEDARVLFKVDPAKVDTVYDMVTKKLGNNEEAPMV

SEQ ID NO: 3035 - protein, 570 aa, Oryza sativa
MGRSRGVPNSGDDETNHRSKRRRVASSGDAPDSLSAACGGAGEGGGKKALYHCNYCNKDISGKIRIKCSKCPDFDLCVECFSVGAEVTPHRSNHPYRVMDNLSFPLICPDWNADEEILLLEGIEMYGLGNWAEVAEHVGTKTKAQCIDHYTTAYMNSPCYPLPDMSHVNGKNRKELLAMAKVQGESKKGTSVLPGDLTPKDESPFSPPRVKVEDALGEGLAGRSPSHIAGGANKKASNVGQFKDGANVAKVEDGHVDRSIGVKKPRYSADEGPSLTELSGYNSKRHEFDPEYDNDAEQALAEMEFKETDSETDRELKLRVLRIYLSRLDERKRRKEFILERNLLFPNPLEKDLTNEDKEVYHRYKVFMRFLSKEEHEALVRSVLEERKIRRRIQELQECRSAGCRTLAEAKIHIEQKRKKEHEVNAQKAKESGQLLSNTKVVHKTNRPMKIESDGNLDQKKGGASLDSTGRDSPKTTGHAGTKHWDDWDIVGFPGAELLSTSEKNLCCQNRLLPNHYLKMQEVLMQEIFKGSVAKKEDAHVLFKVDPAKVDNVYDMVTKKLGTNEEAPTV

SEQ ID NO: 3036 - protein, 565 aa, Sorghum bicolor
MGRSRGVPNSGDDDTGHRSKRRRVSGSGGDATDSISAAIGGAGEGGGKKALYHCNYCNKDISGKIRIKCSKCPDFDLCVECFSVGAEVTPHRSNHPYRVMDNLSFPLICPDWNADEEILLLEGIEMYGLGNWLEVAEHVGTKSKLQCIDHYTTAYMNSPCYPLPDMSHVNGKNRKELLAMAKVQGESKKGTSLLSGELTPKAESPFSPSRVKVEDALGEGPAGRSPSHIAVGANKKASNVGQIKDGANVSKIEDGHVDRSVGVKKPRYSADEGPSLTELSGYNAKRHEFDPEYDNDAEQALAEMEFKETDSETDRELKLRVLRIYLSRLEERKRRKEFILERNLLFPNPLEKDLTNEDREVYHRYKVFMRFLSKEEHEALIRSVIEERKIRRRIQELQECRSAGCRTLAEAKIHIEQKRKKEYELNAQKAKESSLIANNKSVQKMNRSMKIESDGNLDPKKGGAGLDSPKTTGLTSVKQWDDWDIVGLPGAELLSASEKLLCCQNRLLPSHYLRMQEVLMQEIFKGSVLKKEDAHVLFKVDPTKVDSVYDMVTKKLGNHEEAPTV

SEQ ID NO: 3037 - protein, 565 aa, Saccharum officinarum
MGRSRGVPNSGDDDTGHRSKRRRVSSGGDATDSISAAIGGAGEGGGKKALYHCNYCNKDISGKIRIKCSKCPDFDLCVECFSVGAEVTPHRSNHPYRVMDNLSFPLICPDWNADEEILLLEGIEMYGLGNWLEVAEHVGTKSKLQCIDHYTTAYMNSPCYPLPDMSHVNGKNRKELLAMAKVQGETKKGTSLLPGELTPKAESPFSPSRVKMEDALGEGLASRSPSHIAVGANKKASNVGQIKDGANVSKVEDGHVDRSVGVKKPRYSADEGPSLTELSGYNAKRHEFDPEYDNDAEQALAEMEFKETDSETDRELKLRVLHIYLSRLEERKRRKEFILERNLLFPNPLEKDLTNEDREVYHRYKVFMRFLSKEEHEALIRSVIEERKIRRRIQELQECRSAGCRTLAEAKIHIEQKRKKEYELNAQKAKESSHLIANNKLVQKMNRPMKIESDGNLDPKKGGAGLDSPKTTGLTSVKQWDDWDIVGLPGAELLSASEKLLCCQNRLLPSHYLRMQEVLMQEIFKGSVLKKEDAHVLFKVDPTKVDSVYDMVTKKLGNHEEAPTV

SEQ ID NO: 3038 - protein, 387 aa, Panicum virgatum
MAKVQGESKKGTSLLRGELTPKAESPFSPSRVKLEDALGDGPAGRSPSHMAGGANKKASNAGQIKDSSNVSKVEDGHVDRSIGVKKPRYSADEGPSLTELSGYNSKRHEFDPEYDNDAEQALAEMEFKETDSETDRELKLRVLRIYLSRLDERKRRKEFILERNLLFPNPLEKDLTNEDKEVYHRYKVFMRFLSKEEHEALVRSVIEERKIRRRIQELQECRSAGCRTLAEAKIHIEQKRKREYELNSQKSKESGQLIPNNKSVQKMNRPMKIESDGNLDPKKGGTGLDSPKTTGLASVKQWDDWDIVGLPGAELLSASEKLLCCQNRLLPSHYLRMQEVLMQEIFKDNGLKKEDARVLFKVDPSKVDTVYDMVTKKLGNHEEAPTV

SEQ ID NO: 3039 - protein, 58 aa, Triticum aestivum
  misc_feature (22)..(22): Xaa can be any naturally occurring amino acid
RLFMRFLSKEEHEALLRSVIEXRKIRRRIQELQECRSAGCRTLAEAKIHIEQKRSKGV

SEQ ID NO: 3040 - protein, 146 aa, Leymus cinereus x Leymus triticoides
PPGPLLSWARLATSDVHVGGLLVPAGTTAMVNMWAITHDPTVWAKPTEFKPERFLAGPSSDHAAAEFSVTGSDLRLAPFGSGRRSCPGKSLAIATVGFWVATLLHEFEWTPPSSDGPGGVDLSEVLRLSCEMAAPLEARLRPRRAV

SEQ ID NO: 3041 - protein, 214 aa, Triticum aestivum
  misc_feature (2)..(2): Xaa can be any naturally occurring amino acid
  misc_feature (8)..(8): Xaa can be any naturally occurring amino acid
  misc_feature (12)..(12): Xaa can be any naturally occurring amino acid
  misc_feature (18)..(18): Xaa can be any naturally occurring amino acid
  misc_feature (25)..(27): Xaa can be any naturally occurring amino acid
  misc_feature (49)..(49): Xaa can be any naturally occurring amino acid
  misc_feature (56)..(56): Xaa can be any naturally occurring amino acid
  misc_feature (88)..(88): Xaa can be any naturally occurring amino acid
GXDLCGTXTVAXVSNGCXPGCAAPXXXGEGPRGAGPGGRAEPGRDRVGXRLARLLXAVVKEVLRLHPPGPLLSWARLATSDVHVDGLXVPAGTTAMVNMWAITHDPAVWDKPAEFKPERFLAGPSSDHAAAGAEFSVTGSDLRLAPFGSGRRSCPGKSLAIATVGFWVATLLHEFEWTPPSSDGPGGVDLSEVLRLSCEMAAPLEARLRPRRAV

SEQ ID NO: 3042 - protein, 523 aa, Brachypodium distachyon
MSMQQPTCTTLPGAMSLILTAAVALAVAAAVVRYNRKYRGLRLPPGPPGWPIVGNLFQVAFSGKLFIHYIRDLRREYGPILTLRMGVRTLVVISSAELAHEALVQKGQEFASRPAENATRNIFSSNKFTVNSAVYGAEWRSLRRNMVSGMLSTSRLREFRPARRRAMDRFVSRMRAEADAGDDSVWVLRNARFAVFCILLDMTFGLLDLDEAHILRIDAVMKRVLLATGVRMDDYLPFLRPFFRRQQRRALDVRREQVDTLLPLINRRRAILRDRDTRPADPDVAAPFSYLDSLLDLRIEGRDGVASDDELVTLCAELINGGTDTTATAIEWAMARIVDNPSIQARLHEEIMQQVGDTRPVDEKDTDGMPYLQAFVKELLRKHPPTYFSLTHAAVKPGSKLAGYDVPADANLDIFLPGISEDPKLWDRPAEFDPDRFLSGGETADMTGSAGIRMIPFGAGRRICPGLSMGTTHIALMVARMLQAFEWQAHPSQPKLDFKDKVEFTVVMEQPLLAMVTPRKIFF

SEQ ID NO: 3043 - protein, 529 aa, Zea mays
MEASLSLSSLQLAFTAVAAIAALGVAVTVTRYNRRYMGLRLPPGPPGWPVVGNLFQVAFSGKLFIHYIRELRKEYGPILTLRMGERTLVIISSAELAHEALVEKGREFASRPRENTTRNIFSSNKLTVNSAVYGPEWRSLRRNMVSGMLSTSRLREFRHARRRAMDRFVSRMRAEAAASPDGASVWVLRNARFAVFCILLDMTFGLLDLREEHIVRIDAVMKRVLLAVGVRMDDYLPFLRPFFWRHQRRALAVRREQIDTLLPLINRRRAMLRDMQQRQSSSPPPDPSVAAPFSYLDSVLDLRIEGRDDGALTDDELVTLCAELLNGGTDTTATAIEWGMARIVDSPSIQARLHEEVMQQVGDARPVDDKDTDAMPYLQAFVKELLRKHPPTYFSLTHAAVQPGCKLAGYDVPVDANLDIFLPTISEDPKLWDRPTEFDPDRFVSGGETADMTGSAGIRMIPFGAGRRICPGLAMGTTHIALMVARMVQAFEWRAHPSQPQLDFKDKVEFTVVMDRPLLAAVKPRNLAF

SEQ ID NO: 3044 - protein, 544 aa, Sorghum bicolor
MPMQQPTSVVHAAMEEASLSSLSFLQLAFTAVAATAALALAVAVTRYNRRYTGLRLPPGPPGWPVVGNLFQVAFSGKLFIHYIRDLRKEYGPILTLRMGERTLVIISSAELAHEALVEKGREFASRPRENTTRNIFSSNKFTVNSAVYGAEWRSLRRNMVSGMLSTSRLREFAHARRRAMDRFVSRMRAEAAASPDGGSVWVLRNARFAVFCILLDMTFGLLDLHEEHIVRIDAVMKRVLLAVGVRMDDYLPFLRPFFWRHQRRALAVRREQIDTLLPLISRRRAILRDMQQRSSSPSPPPDPNVAAPFSYLDSVLDLHIEGRDGAPTDDELVTLCAELINGGTDTTATAIEWGMARIVDNPSIQARLHEEIMQQVGDARPVDDKDTDAMPYLQAFVKELLRKHPPTYFSLTHAAVQPGSKLAGYDVPVDANLDIFLPAISEDPKLWDRPTEFDPDRFLSGGETADMTGSGGIRMIPFGAGRRICPGLAMGTTHIALMVARMVQAFEWRAHPSQPPLDFKDKVEFTVVMDRPLLAAVKPRNLSF

SEQ ID NO: 3045 - protein, 525 aa, Panicum virgatum
MEEAASLLSVLQLAFTAAVATAALAVAVAAARYNRRYRGLRLPPGPPGWPVVGNLLQVAFSGKLFIHHIRDLRREYGPILTLRMGERTLVIISSAELAHEALVEKGQEFASRPRENTTRNIFSSNKFTVNSAVYGPEWRSLRRNMVSGMLSTSRLREFRPARARAMDRFVARMRAEAAASPDGASVWVLRNARFAVFCILLDMTFGLLDLPEEHIVRIDAVMKRVLLAVGVRMDDYLPFLRPFFWRHQRRALAVRREQVDTLLPLIDRRRSILRGAASSPPDPAVAAPFSYLDSLLDLRVEGRGGAAPTDDELVTLCAELINGGTDTTATAIEWGMARIVDNPAIQARLHEEIARQVGGARPVDDRDTEAMPYLQAFVKELLRKHPPTYFSLTHAAARPGCKLAGYDVPADANLDIFLPAISEDPKLWERPAEFDPERFLSGGEAADMTGSAGIRMIPFGAGRRICPGLAMGTTHIALMVARMVQAFEWRAHPSQPPPDFKDKVEFTVVMDRPLLAAVRPRSLSF

SEQ ID NO: 3046 - protein, 536 aa, Triticum aestivum
  misc_feature (350)..(350): Xaa can be any naturally occurring amino acid
MSMQQQQQQPARANLLGAMPAASMISLAFTAAVATAALWVAVAVARYNRKYRGLRLPPGPHGWPIVGNLFQVAFSGKLFIHYIRDLRREYGPILTLRMGVRTLVVISSAELVHEALVEKGTEFASRPAENTTRNIFSSNKFTVNSAVYGAEWRSLRRNMVSGMLSTSRLREFRPARLRAMDRFVARMRAEAAASADGASVWVLRNARFAVFCILLDMTFGLLDLDEEHIVHIDAVLKRVLLAVGVRMDDYLPFLRPFFWRKQLRALAVRREQVDTLLPLINRRRAILRDMQSSPPDPNVAAPFSYLDSLLDLHIEGREGADDELVTLCAELINGGTDTTATAIEWAMARXVDNPSIQARLHEEIMQQVGDARPIDDKDIESMPYLQAFVKELLRKHPPTYFSLTHAAVKPGSKLAGYDVPTDANLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 3047 - protein, 162 aa, Saccharum officinarum
  misc_feature (149)..(149): Xaa can be any naturally occurring amino acid
MARTINSLMYKGSIPDAINQSRREKKLFVVYISGEDEASSNLEQSTLIDENVVEVIGRCCILLHLKQGNVDASQFSAIYPQKSVPSISVIGLNGVLLWNHDGYINSENLKESIEKAWAALHLQETAATLLTASLASRNAESVNTATTGXGSSRGLFYFRKSF

SEQ ID NO: 3048 - protein, 388 aa, Sorghum bicolor
MASASRALLLSRALQAGAASRRVPTLLRPLAAAASLLPAAAAAAAPGAGVRCFATQPATSSLRDSSPNWSNRPPKETILLDGCDFEHWLVVMEPPPGDASNPDITRDEIIDSYIKTLAQIVGSEEEARQKIYSVSTRHYFAFGALVSEELSYKLKEMPKVRWVLPDSYLDVKNKDYGGEPFINGEAVPYDPKYHEEWVRNNARANERSRRNDRPRNFDRSRNFERRRENMQNFQNRDGPPAQGFSGPPPPPGQNQMPPQHVQGNMPPPPPHAGGGQPNYQPQMPNPQAGYNPGGAPHYQQGGAPGYQGGPPGYQGGNQGYQGNPGPAYQGGNPGYQGGPPGYPGGNPPPPPPYQGGNPNAPPYPGGGNPGYPGGSPGYQGQGGNSNFQ

SEQ ID NO: 3049 - protein, 556 aa, Aquilegia formosa
MDGIREMGLRNVASQCSISEVDDYDLSKLLDKPKLNIERQRSFDERSLSELSVGFSRGGLEVFETVYSPGGRSAFDTPASSARHSFEPHPMVAEAWEALRRSLVSFRGQPVGTVAAHDFSDEVLNYDQVFVRDFVPSALAFLMNGEPDIVKNFLLKTLHLQGWEKRIDRFKLGEGVMPASFKVLHDPARKTDSLVADFGESAIGRVAPVDSGFWWIILLRAYTKSTGDLSLAETPECQKGMRLILSLCLSEGFDTFPTLLCADGCSMIDRRMGIYGYPIEIQALFFMALRCALTLLKHDTEGKEFVERIVKRLHALSYHMRSYFWLDFQQLNDIYRYKTEEYSHTAVNKFNVIPDSIPEWVFDFMPTRGGYFIGNVSPARMDFRWFALGNLFAILSSLATPEQSVAIMDLIESRWEELVGEMPLKISYPAIESHDWRIVTGCDPKNTRWSYHNGGSWPVLLWMLTAACIKTGRPQIARRAIDLAESRLLKDNWPEYYDGKLGRYVGKQARKFQTWSIAGYLVAKMMLEDPSHLGMISLEEDKQMKPLIKRSSSWTC

SEQ ID NO: 3050 - protein, 557 aa, arabidopsis lyrata
MEGHKEPLWLRVEGSHCSLSEMDDFDLTRALEKPRQLKIERKRSFDERSMSELSTGYARQDSILEMAHSPGSRSMVDTPLSVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFKVLHDPVRKTDTIVADFGESAIGRVAPVDSGFWWIILLRAYTKSTGDLTLSETPECQRGMRLILSLCLSEGFDTFPTLLCADGCSMVDRRMGVYGYPIEIQALFFMALRCALSMLKPDEEGREFIERIVKRLHALSFHMRSYFWLDFQQLNDIYRYKTEEYSHTAVNKFNVMPDSIPDWVFDFMPLRGGYFVGNVSPARMDFRWFSLGNCVSILSSLATPDQSMAIMDLLEHRWEELVGEMPLKICYPCIESHEWRIVTGCDPKNTRWSYHNGGSWPVLLWTLTAACIKTGRPQIARRAIDLIESRLHRDCWPEYYDGKQGRYVGKQARKYQTWSIAGYLVAKMMLEDPSHIGMISLEEDKQMKPVIKRSASWTC

SEQ ID NO: 3051 - protein, 554 aa, Artemisia annua
  misc_feature (169)..(169): Xaa can be any naturally occurring amino acid
MDAPKEAGLRNVSSVCSIPEMDDFELTKLLDTPRLTIKRERSFDERSLSEMSISRGLDNLDIAYSPGGRSGFDTPASSTRNSFEPHPMIAEAWDSLRRSLVHFRGQPVGTIAAYDHASEEVLNYDQVFVRDFVPSALAFLMNGEPDIVKNFLLKTLQLQGWEKKVDRFXLGEGAMPASFKVLHDPERKTDTIVADFGESAIGRVAPVDSGFWWIILLRAYTKSTGDLTLAETPDCQKGMRLILNLCLSEGFDTFPTLLCADGCSMIDRRMGIYGYPIEIQALFFMALRCSLAMLKLDAEGKEFADRIMKRLHALSFHMRSYFWIDFQQLNDIYRYKTEEYSHTAVNKFNVIPDSIPDWVFDFMPTRGGYFVGNVSPARMDFRWFALGNCVAILSSLATPEQASAIMDLFEARWEELVGEMPIKICYPAIESHEWRIVTGCDPKNTRWSYHNGGSWPVLLWLLTAACIKTGRPQIARRAIELAESRLLKDGWPEYYDGKNGRYIGKQARKYQTWSIAGYLVAKMMLEDPSHLGMISLEDDRQLKPIIKRSASWTC

SEQ ID NO: 3052 - protein, 550 aa, Brassica rapa
MECPKEPLESQCSLSEMDDFDLTRALDKPRLKIERKRSFDERSMSELSTGYSRHDLDMAHSPGSRSFVDTPLSYVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFKVLHDPVRKTDTIVADFGESAIGRVAPVDSGFWWIILLRAYTKSTGDLTLSETPECQRGIRLILSLCLSEGFDTFPTLLCADGCSMVDRRMGVYGYPIEIQALFFMALRSALSMLKHDEEGREFIEKIVKRLHALSFHMRNYFWLDFQQLNDIYRYKTEEYSHTAVNKFNVMPDSIPDWVFDFMPLRGGYFVGNVSPARMDFRWFSLGNCVAILSSLATPDQSMAIMDLLEHRWEELVGEMPLKICYPCIESHEWRIVTGCDPKNTRWSYHNGGSWPVLLWMLTAACIKTGRPQIARRAIDLIESRLHRDCWPEYYDGKLGRYVGKQARKYQTWSIAGYLVAKMMLEDPSHIGMISLEEDKQMKPVLKRSASWTC

SEQ ID NO: 3053 - protein, 559 aa, Brachypodium distachyon
MELGAGGMRRSASHTSLSESDDFDLSRLLNKPRINVERQRSFDDRSLSDVSYSGGHARGGGGFDGMYSPGGGLRSLVGTPASSALHSFEPHPIVGDAWEALRRSLVFFRGQPLGTIAAYDHASEEVLNYDQVFVRDFVPSAMAFLMNGEPEIVKNFLLKTVLLQGWEKKVDRFKLGEGAMPASFKVLHDDKKGTDTLHADFGESAIGRVAPVDSGFWWIILLRAYTKSTGDLTLAEKPECQKAMRLILSLCLSEGFDTFPTLLCADGCCMIDRRMGVYGYPIEIQSLFFMALRCALLMLKHDAEGKDFVERIATRLHALSYHMRSYFWLDFQQLNDIYRYKTEEYSHTAVNKFNVIPDSIPDWLFDFMPCQGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIARRAIDLAERRLLKDGWPEYYDGKLGKYVGKQARKFQTWSIAGYLVAKMLLEDPSHLGMIALEEDKAMKPVLRRSASWTN

SEQ ID NO: 3054 - protein, 564 aa, Brachypodium distachyon
MEAAAAATTTNKAPSMADPEDDFDLSRLLNHRPRINVERQRSFDDRSLGDLYLSAMDGRSGGYMDSYDTMYSPGGGLRSLSGTPASSTRHSFEPYPLVFEAWEALRRSLVCFRGQPLGTIAAVDHSAGEVLNYDQVFVRDFVPSALAFLMNGEPEIVKNFLLKTLLLQGWEKRIDRFKLGEGAMPASFKVLKDPKRGVDTLSADFGESAIGRVAPADSGFWWIILLRAYTKSTGDLTLAETPECQKGIRLIMNQCLAEGFDTFPTLLCADGCCMIDRRMGVYGYPIEIQALFFMALRCALLLLKPEGEGNKDTVERIVTRLHALSYHMRAYFWLDFQQLNVIYRFKTEEYSHTAVNKFNVIPESIPDWLLDFMPSKGGYFVGNVSPARMDFRWFALGNCVAILASLATPDQAAAIMDLIEERWEDLVGEMPLKICYPAIEGHEWQSVTGCDPKNTRWSYHNGGSWPVLLWLLTAACIKTGRLKIARRAIDLAEARLAKDSWPEYYDGKLGRYVGKQARKHQTWSIAGYLVAKMMLEDPSHLGMISLEEDKAMNPVLKRSASWTV

SEQ ID NO: 3055 - protein, 557 aa, Manihot esculenta
MDGTKEIGLRNVSSTCSISEMDDFDLSRLLDKPRLNIERQRSFDERSLSELSIGLTRGGLDIYESTYSPGGRSGFDTPASSTRNSFEPHPMVADAWEALRRSIVYFRGQPVGTIAAIDHASEEVLNYDQVFVRDFVPSALAFLMNGEPEIVKNFLLKTLHLQGWEKRIDRFKLGEGAMPASFKVLHDPVRKTDTLIADFGESAIGRVAPVDSGFWWIILLRAYTKSTGDLSLAETPECQKGMRLILTLCLSEGFDTFPTLLCADGCSMIDRRMGIYGYPIEIQALFFMALRCALSMLKHDTEGKECIERIVKRLHALSYHMRGYFWLDFQQLNDIYRYKTEEYSHTAVNKFNVIPDSIPDWVFDFMPTRGGYFIGNVSPARMDFRWFALGNCVAILSSLATPEQSMAIMDLIESRWEELVGEMPMKIAYPAIESHEWRIVTGCDPKNTRWSYHNGGSWPVLLWMLTAACIKTGRPQIARRAIDLAETRLLKDGWPEYYDGKVGRFIGKQARKYQTWSIAGYLVAKMMLEDPSHLGMISLEEDKQMKPVIKRSTSWTC

SEQ ID NO: 3056 - protein, 557 aa, Manihot esculenta
MDGTKEMGLKNVSSTCSISEMDDFDLSRLLDKPRLNIERKRSFDERSLSELSIGLTRGGLDNYETTYSPGGRSGFDTPASSTRNSFEPHPMVADAWEALRRSIVYFRGQPVGTIAAIDHASEEILNYDQVFVRDFVPSALAFLMNGEPEIVKNFLMKTLYLQGWEKRIDRFKLGEGAMPASFKVLHDPIRKTDTLIADFGESAIGRVAPVDSGFWWIILLRAYTKSTGDLSLAETPECQKGMKLILTLCLSEGFDTFPTLLCADGCSMIDRRMGIYGYPIEIQALFFMALRCALSMLKHDTEGKEFIERISKRLHALSYHMRSYFWLDFQQLNDIYRYKTEEYSHTAVNKFNVIPDSIPDWVFDFMPTRGGYFIGNVSPARMDFRWFALGNCVAILSSLATPEQSMAIMDLIESRWEELVGEMPLKIAYPAIESHDWRIVTGCDPKNTRWSYHNGGSWPVLLWMLTAACIKTGRPQIARRAIDLAETRLLKDSWPEYYDGKLGKFIGKQARKYQTWSIAGYLVAKMMLEDPSHLGMVSLEEDKQMKPVMKRSSSWTC

SEQ ID NO: 3057 - protein, 552 aa, Ricinus communis
MDMGLRNVSSTCSISEMDDFDLSRLLDKPRLNIERQRSFDERSLSELSIGLTRGHDNYESTYSPGGRSGFDTPASSARNSFEPHPMVADAWEALRKSIVYFRGQPVGTIAAIDHASEEVLNYDQVFVRDFVPSALAFLMNGEPEIVKNFLLKTLHLQGWEKRIDRFKLGDGVMPASFKVLHDPVRKTDTLIADFGESAIGRVAPVDSGFWWIILLRAYTKSTGDHSLAETPECQKGMRLILTLCLSEGFDTFPTLLCADGCSMVDRRMGIYGYPIEIQALFFMALRCALSMLKDDGENKECTERIVKRLHALSYHMRSYFWLDFQQLNDIYRYKTEEYSHTAVNKFNVIPDSIPEWVFDFMPTRGGYFIGNVSPARMDFRWFALGNCVAILSSLSTPEQSNAIMDLIEARWEELVGEMPLKISYPAIEGHEWRIVTGCDPKNTRWSYHNGGSWPVLLWLLTAACIKTGRPQIARRAIDLAEARLLKDGWPEYYDGKLGRYMGKQARRYQTWSIAGYLVAKMMLEDPSHLGMISLEEDKQMKPVLKRSTSWTC

SEQ ID NO: 3058 - protein, 534 aa, Castanea mollissima
YDLSRLLDKPRLNIERQRSFDERSLSELSIGLARGGLDNFESTCSPGGRSGFETPASSARNSFEPHPMVADAWEALRRSLVYFRGQPVGTIAAVDHASEEVLNYDQVFVRDFVPSALAFLMNGEPDIVKNFLLKTLYLQGWEKRIDRFKLGEGAMPASFKVLHDPIRKTDTLIADFGESAIGRVAPVDSGFWWIILLRAYTKSTGDLTLAETSDCQKGMKLILTLCLSEGFDTFPTLLCADGCSMIDRRMGVYGYPIEIQALFFMALRCALAMLKPDTEGKEFIERIVKRLHALSYHMRSYFWLDFQQLNDIYRYKTEEYSHTAVNKFNVIPDSIPEWVFDFMPTRGGYFIGNVSPARMDFRWFALGNCVAIMSSLATPEQSMAIMDLLESRWEELVGEMPLKISYPAIESHEWRIVTGCDPKNTRWSYHNGGSWPVLLWLLTAACIKTGRPQIARRAIELAENRLLKDNWPEYYDGKTGRYIGKQARKYQTWSIAGYLVAKMMLEDPSHLGMISLEEDKQMKPALKRSSSWTC

SEQ ID NO: 3059 - protein, 559 aa, Gossypium hirsutum
MEGTKEMGLRNVSSTCSINEMDDYDLSRLLDKPRLNIERQRSFDERSLSELSIGLTRAGLDNYETTYSPGGRSRSGFDTPASSTRNSFEPHPMVAEAWEALRRSLVYFRDQPVGTIAAYDHASEEVLNYDQVFVRDFVPSALAFLMNGEPDIVKNFLLKTLQLQGWEKRIDRFKLGEGAMPASFKVLHDPVRKSDTIIADFGESAIGRVAPVDSGFWWIILLRAYTKSTGDLSLAETPECQKGMRLILTLCLSEGFDTFPTLLCADGCSMIDRRMGIYGYPIEIQALFFMALRCALSMLKHDAEGKECIERIVKRLHALSYHMRSYFWLDFQQLNDIYRYKTEEYSHTAVNKFNVIPDSIPDWVFDFMPTRGGYFIGNVSPARMDFRWFCLGNCIAILSSLATPEQSMAIMDLIEARWDELVGEMPLKIAYPAIESHEWRIVTGCDPKNTRWSYHNGGSWPVLLWLLTAACIKTGRPLIARRAIDLAETRLFKDSWPEYYDGKLGRYIGKQARKYQTWSIAGYLVAKMMLEDPSHLGMISLEEDKQMKPLLKRSSSWNC

SEQ ID NO: 3060 - protein, 557 aa, Gossypium hirsutum
MDGAKETGLRNVSSTCSISESDDYDLSRLLDKPRLNIERQRSFDERSLGELSIGLARGAHDNYETTHSPGWRSGFNTPASSARNSFEPHPMVADAWEALRRSLVYFKGQPVGTIAAYDHASEEVLNYDQVFVRDFVPSALAFLMNGEPEIVKNFLVKTLHLQGWEKRIDRFKLGEGAMPASFKVLHDPVRKSDTIIADFGESAIGRVAPVDSGFWWIILLRAYTKSTGDLSLAETPECQKGMRLILTLCLSEGFDTFPTLLCADGCSMIDRRMGIYGYPIEIQALFFMALRCALSMLKHDAEGKECIERIVKRLHALSYHMRSYFWLDFQQLNDIYRYKTEEYSHTAVNKFNVIPDSIPDWVFDFMPTRGGYFIGNVSPARMDFRWFCLGNCIAILSSLATPEQSMAIMDLIEARWDELVGEMPLKIAYPAIESHEWRIVTGCDPKNTRWSYHNGGSWPVLLWLLTAACIKTGRPQIARRAIDLAETRLLKDGWPEYYDGKLGRYVGKQARKYQTWSIAGYLVAKMMMEDPSHLGMISLEEDKQMKPLIKRSSSWTC

SEQ ID NO: 3061 - protein, 554 aa, cucumber
MDGFGLRNVSSHCSISEMDDYDLSRLLDKPKLNIERQRSFDERSLSELSIGLARGGLDNFESSYSPGGRSGFDTPASSSRNSFEPHPMIAEAWEALRRSMVYFRGQPVGTIAAYDHASEEVLNYDQVFVRDFVPSALAFLMNGEPDIVKNFLLKTLQLQGWEKRIDRFKLGEGAMPASFKVLHDPVRKTDTVAADFGESAIGRVAPVDSGFWWIILLRAYTKSTGDLSLAETSECQKGMRLILTLCLSEGFDTFPTLLCADGCSMIDRRMGIYGYPIEIQALFFMALRCALAMLKHDAEGKECIERIVKRLHALSYHMRSYFWLDFQQLNDIYRYKTEEYSHTAVNKFNVIPDSIPEWLFDFMPTRGGYFVGNVSPARMDFRWFALGNCVAILGSLATPEQSMAIMDLIESRWEELVGEMPLKISYPAIESHEWRIITGCDPKNTRWSYHNGGSWPVLLWLLTAACIKTGRPQIARRAIELAESRLLKDSWPEYYDGKLGRYIGKQARKYQTWSIAGYLVAKMMLEDPSHLGMISLEEDKQMKPLIKRSSSWTC

SEQ ID NO: 3062 - protein, 556 aa, Lotus japonicus
MDGPVGLKKISSQCSIPEMDDFDQLSRLLDKPRLNIERQRSFDERSLSELSQGFARAGVDNYENYSPGVRSGFNTPASSARNSFEPHPMVADAWESLRRSLVYFKGQPVGTIAAVDHQAEEVLNYDQVFVRDFVPSALAFLMNGEPDIVRNFLLKTLHLQGWEKRIDRFKLGEGVMPASFKVLHDPVRKTDTLIADFGESAIGRVAPVDSGFWWIILLRAYTKSTGDLTLAESPDCQKGMKLILTLCLSEGFDTFPTLLCADGCSMIDRRMGIYGYPIEIQALFFMALRCALSMLKQDDAEGKECVERIVKRLHALSYHMRGYFWLDFQQLNDIYRYKTEEYSHTAVNKFNVIPDSIPEWVFDFMPTRGGYFIGNVSPARMDFRWFALGNCVAILSSLATPEQSMAIMDLIEARWDELVGEMPLKISYPAIESHEWRIVTGCDPKNTRWSYHNGGSWPVLLWLVTAACIKTGRPQIARRAIELAESRLLKDGWPEYYDGKLGRYVGKQARKYQTWSIAGYLVAKMMLEDPSHLGMISLEEDKQMKPVIKRSSSWTC

SEQ ID NO: 3063 - protein, 559 aa, Zea mays
MELAVGGGMRRSASHTSLSESDDFELTRLLSKPRINVERQRSFDDRSLSDVSHSGGYGRGGFDGMYSPGGGLRSLVGTPASSGLHSFEPHPIVGDAWEALRRSLVLFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDRAMLKPVLKRSASWTN

SEQ ID NO: 3064 - protein, 568 aa, Zea mays
MEAAPMRKASSQASLADPDDFDLTRLLNHKPRINVDRQRSFDDRSLGEISLAGAGTASRGGWGYGGGGMESYESMYSPGGGLRSYCGTPASSTRLSFEPHPLIGEAWDALRRSMVSFRGQPLGTIAAVDHSSGEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKFNVNPESIPDWLFDFMPTRGGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKLQTWSIAGYLVAKMMVEDPSHLGMISLEEEKPTKPVLRRSASWTG

SEQ ID NO: 3065 - protein, 555 aa, Medicago truncatula
MDGHMGIRKVGSQCSMAEMDDFDLTRLLDRPRLNIERQRSFDERSLSELSVGFARAGLDNYDNYSPGGRSGFNTPASSARNSFEPHPMVADAWESLRKSLVHFRGAPVGTIAAVDHQAEEVLNYDQVFVRDFVPSALAFLMNGEPEIVKNFLLKTLHLQGWEKRVDRFKLGEGVMPASFKVLHDAVRKTDTLIADFGESAIGRVAPVDSGFWWIILLRAYTKSTGDLTLSESDSCQKGMKLILTLCLSEGFDTFPTLLCADGCCMIDRRMGVYGYPIEIQALFFMALRSALSMLKQDTADGKECVERVVKRLHALSFHMRSYFWLDFQQLNDIYRYKTEEYSHTAVNKFNVIPDSIPEWVFDFMPTRGGYFIGNVSPARMDFRWFALGNCVAILSSLATPEQSMAIMDLIEARWDELVGEMPLKISYPAIESHEWRIVTGCDPKNTRWSYHNGGSWPVLLWLVTAACIKTGRPQIARRAIELAESRLLKDGWPEYYDGKLGRYVGKQARKYQTWSIAGYLVAKMMLEDPSHLGMISLEEDKQMKPVIKRSSSWTC

SEQ ID NO: 3066 - protein, 380 aa, Quercus alba
MPASFKVLHDPIRKTDTLIADFGESAIGRVAPVDSGFWWIILLRAYTKSTGDLTLAETSDCQKGMKLILTLCLSEGFDTFPTLLCADGCSMIDRRMGVYGYPIEIQALFFMALRCALAMLKPDTEGKEFIERIVKRLHALSYHMRSYFWLDFQQLNDIYRYKTEEYSHTAVNKFNVIPDSIPEWVFDFMPTRGGYFIGNVSPARMDFRWFALGNCVAIMSSLATPEQSMAIMDLLESRWEELVGEMPLKISYPAIESHEWRIVTGCDPKNTRWSYHNGGSWPVLLWLLTAACIKTGRPQIARRAIELAENRLLKDNWPEYYDGKTGRYIGKQARKYQTWSIAGYLVAKMMLEDPSHLGMISLEEDKQMKPALKRSSSWTC

SEQ ID NO: 3067 - protein, 557 aa, Populus trichocarpa
MDGTKEMGGLRNVSSVCSISEMDDFDLSRLLDKPKLNIERQRSFDERSLSELSIGLARGIDTFETTYSPGGRSGFNTPASSTRNSFEPHPMVADAWEALRRSLVYFRGQPVGTIAAYDHASEEVLNYDQVFVRDFVPSALAFLMNGEPDIVKHFLLKTLYLQGWEKRIDRFKLGEGAMPASFKVLHDPIRKTDSLVADFGESAIGRVAPVDSGFWWIILLRAYTKSTGDLSLAERPECQKGMKLILTLCLSEGFDTFPTLLCADGCSMIDRRMGIYGYPIEIQALFFMALRSASSMLKHDQEGNEFIERIVKRLHALSYHMRSYFWLDFQQLNDIYRYKTEEYSHTAVNKFNVIPDSIPDWVFDFMPIRGGYFIGNVSPARMDFRWFALGNCIAILSSLATHEQAMAIMDLIEARWEELVGEMPLKIAYPAIESHEWRIVTGCDPKNTRWSYHNGGSWPVLLWLLTAACIKTGRPQIARKAIDLAETRLLKDGWPEYYDGKLGRYVGKQARKYQTWSIAGYLVAKMMLEDPSHLGMISLEEDRQMKPVLRRSSSWTC

SEQ ID NO: 3068 - protein, 557 aa, Populus trichocarpa
MDATKETVGLMNGSSVWSISEMDDIDFSRLSDKPKLNIERKRSFDERSLSELSIGLARGIDNFETTNSPGGRSGFNTPASSARNSFEPHPMVADAWEALRRSLVFFRGQPVGTIAAYDHASEEVLNYDQVFVRDFVPSALAFLMNGEPEIVKQFLLKTLHLQGWEKRIDRFKLGEGAMPASFKVLHDPIRKTDSLVADFGESAIGRVAPVDSGFWWIILLRAYTKSTGDLSLAETPECQKGMRLILTLCLSEGFDTFPTLLCADGCSMIDRRMGIYGYPIEIQALFFMALRSACSLLKHDEEGKECIERIVKRLHALSYHMRSYFWLDFQQLNDIYRYKTEEYSHTAVNKFNVIPDSIPDWVFDFMPTRGGYFIGNVSPARMDFRWFALGNCIAILSSLATHEQAMAIMDLIEARWEELVGEMPLKIAYPAIESHEWRIVTGCDPKNTRWSYHNGGSWPVLLWLLTAACIKTGRPQIARKAIDLAETRLLKDSWPEYYDGKLGRYIGKQARKYQTWSIAGYLVAKMMLEDPSHLGMISLEEDKQMNPVLKRSSSWTC

SEQ ID NO: 3069 - protein, 562 aa, Oryza sativa
MELAVGAGGMRRSASHTSLSESDDFDLSRLLNKPRINVERQRSFDDRSLSDVSYSGGGHGGTRGGFDGMYSPGGGLRSLVGTPASSALHSFEPHPIVGDAWEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 3070 - protein, 552 aa, Solanum phureja
MEGTGLRNVSSHCSISEMDDFDLSKLLDKPRINIERQRSFDERSLSELSIGLSRGLDNYENTYSPGRSGLDTPASSARNSFEPHPMVAEAWDALRRSMVHFRGQPVGTIAAVDHAAEEVLNYDQVFVRDFVPSALAFLMNGEPDIVKNFLLKTLQLQGWEKRVDRFKLGEGVMPASFKVLHDPVRKTDTIMADFGESAIGRVAPVDSGFWWIILLRAYTKSTGDVSLAETPECQRGMRLILSLCLSEGFDTFPTLLCADGCSMIDRRMGIYGYPIEIQALFFMALRSALAMLKHDTEGGEFVERIVKRLHALSYHMRSYFWLDFQQLNDIYRYKTEEYSHTAVNKFNVIPDSIPDWVFEFVPKRGGYFIGNVSPARMDFRWFALGNCIAILSSLATPEQASAIMDLIEARWDELVAEMPLKISYPALENHDWRLITGCDPKNTRWSYHNGGSWPVLLWLLTAACIKTGRPQIARRAIDLAESRLSKDSWPEYYDGTVGRYIGKQARKYQTWSIAGYLVAKMLLEDPSHLGMIALEEDKQMKPVIKRSASWTC

SEQ ID NO: 3071 - protein, 551 aa, Solanum phureja
MEETGLRNVGSNCSISEIDDYDLSKLLNKPRLNIERKRSFDERSLSELSIGLSRGLDHYESASPGRSVLDTPVSSARNSFEPHPMVAEAWDALRRTMVHFRGQPVGTIAAIDHASEEVLNYDQVFVRDFVPSALAFLMNGEPDIVKNFLLKTLQLQGWEKRVDRFKLGEGVMPASFKVLHDPVRKTDTIVADFGESAIGRVAPVDSGFWWIILLRAYTKSTGDLSLSETTECQKGMRLILSLCLSEGFDTFPTLLCADGCSMIDRRMGVYGYPIEIQALFFMALRSALAMLKHDTEGKEFIERIVKRLHALSYHMRSYFWLDFQQLNDIYRYKTEEYSHTAVNKFNVIPDSIPEWVFDFVPTRGGYFIGNVSPARMDFRWFALGNCIAILSSLATPEQASAIMDLIEARWEELVADMPLKICYPAIENHEWRIVTGCDPKNIRWSYHNGGSWPVLLWLLTAACIKTGRPQIARRAIDLAESRLLKDSWPEYYDGKLGRYIGKQARKHQTWSIAGYLVAKMLLEDPSHLGMISLEEDKQMKHVIKRSSSWTF

SEQ ID NO: 3072 - protein, 559 aa, Sorghum bicolor
MELAVGGGMRRSASHTSLSESDDFELTRLLSKPRINVERQRSFDDRSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDMTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGDMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 3073 - protein, 555 aa, Glycine max
MDGHMGMRKISSHCSIPDLDDSDLLRLLEKPKLNIERQRSFDERSLSELSIGLARAGLDNYDTYSPGGRSGFNTPASSTRNSFEPHPMVADAWESLRKSLVYFRGQPVGTIAAVDHQSEEVLNYDQVFVRDFVPSALAFLMNGEPEIVRNFLLKTLHLQGWEKRVDRFKLGEGVMPASFKVLHDPIRKTDTLIADFGESAIGRVAPVDSGFWWIILLRAYTKSTGDLSLAESPDCQKGMKLILTLCLSEGFDTFPTLLCADGCCMVDRRMGIYGYPIEIQALFFMALRCALSMLKQDDAEGKECVERIVKRLHALSYHMRSYFWLDFQQLNDIYRYKTEEYSHTAVNKFNVIPDSIPDWVFDFMPMRGGYFIGNVSPARMDFRWFALGNCVAILSSLATPEQSMAIMDLIESRWDELVGEMPLKISYPAIESHEWQIVTGCDPKNTRWSYHNGGSWPVLLWLVTAACIKTGRPQIARRAIELAESRLLKDGWPEYYDGKLGRYIGKQARKYQTWSIAGYLVAKMMLEDPSHLGMISLEEDKQMKPVIKRSSSWTC

SEQ ID NO: 3074 - protein, 555 aa, Glycine max
MDGHMGMRKISSHCSIPDLDDSDILRLLEKPKLNIERQRSFDERSLSELSIGLARAGLDNYDTYSPGGRSGFNTPASSTRNSFEPHPMVADAWESLRKSLVYFRGQPVGTIAAVDHQSEEVLNYDQVFVRDFVPSALAFLMNGEPEIVRNFLLKTLHLQGWEKRVDRFKLGEGVMPASFKVLHDPIRKTDTLIADFGESAIGRVAPVDSGFWWIILLRAYTKSTGDLSLAESPDCQKGMKLILTLCLSEGFDTFPTLLCADGCCMVDRRMGIYGYPIEIQALFFMALRCALSMLKQDDAEGKECVERIVKRLHALSYHMRSYFWLDFQQLNDIYRYKTEEYSHTAVNKFNVIPDSIPEWVFDFMPMRGGYFIGNVSPARMDFRWFALGNCVAILSSLATPEQSMAIMDLIESRWDELVGEMPLKISYPAIESHEWRIVTGCDPKNTRWSYHNGGSWPVLLWLVTAACIKTGRPQIARRAIELAESRLLKDGWPEYYDGKLGRYIGKQARKYQTWSIAGYLVAKMMLEDPSHLGMISLEEDKQMKPVIKRSSSWTC

SEQ ID NO: 3075 - protein, 559 aa, Saccharum officinarum
MELAVGGGMRRSASHTSLSESDDFELTRLLSKPRINVERQRSFDDRSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKIDRFKLGEGAMPASFKVMHDAKKGVETLHADFGESAIGRVAPVDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 3076 - protein, 560 aa, Panicum virgatum
MELAVGGGMRRSASHTSLSESDDFELTRLLSKPRINVERQRSFDDRSLSDVSHSGGYGRGGAFDGMYSPGGGLRSLVGTPASSALHSFEPHPIVGDAWEALRRSLVFFRGQPLGTVAAVDHASEEVLNYDQVFVRDFVPSALAFLMNGEPDIVRNFLLKTLLLQGWEKKVDRFKLGEGAMPASFKVMHDAKKGVETLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSAAIMDLIEERWEELIGEMPLKICYPAIENHEWRIVTGCDPKNTRWSYHNGGSWPVLLWLLTAACIKTGRPQIARRAIDLAERRLLKDGWPEYYDGTLGRYVGKQARKFQTWSIAGYLVAKMMLEDPSHLGMISLEEDRAMLKPVLKRSASWTN

SEQ ID NO: 3077 - protein, 552 aa, Solanum lycopersicum
MEGSGLKNVSSHCSISEMDDFDLSKLLDKPRINIERQRSFDERSLSELSIGLSRGLDNYENAYSPGRSGLDTPASSARNSFEPHPMVAEAWDALRRSMVHFRGQPVGTIAAVDHAAEEVLNYDQVFVRDFVPSALAFLMNGEPDIVKNFLLKTLQLQGWEKRVDRFKLGEGVMPASFKVLHDPVRKTDTIMADFGESAIGRVAPVDSGFWWIILLRAYTKSTGDVSLAETPECQRGMRLILSLCLSEGFDTFPTLLCADGCSMIDRRMGIYGYPIEIQALFFMALRSALAMLKHDTEGGEFVERIVKRLHALSYHMRSYFWLDFQQLNDIYRYKTEEYSHTAVNKFNVIPDSIPDWVFEFVPKRGGYFVGNVSPARMDFRWFALGNCIAILSSLATPEQASAIMDLIEARWDELVAEMPLKISYPALENHDWRHITGCDPKNTRWSYHNGGSWPVLLWLLTAACIKTGRPQIARRAIDLAESRLSKDSWPEYYDGTVGRYIGKQARKYQTWSIAGYLVAKMLLEDPSHLGMIALEEDKQMKPVIKRSASWTC

SEQ ID NO: 3078 - protein, 551 aa, Solanum lycopersicum
MEETGLRNVGSNCSISEIDDYDLSKLLNKPRLNIERKRSFDERSLSELSIGLSRGLDHYESASPGQSVLDTPVSSARNSFEPHPMVAEAWDALRRTMVHFRGQPVGTIAAIDHASEEVLNYDQVFVRDFVPSALAFLMNGEPDIVKNFLLKTLQLQGWEKRVDRFKLGEGVMPASFKVLHDPVRKTDTIVADFGESAIGRVAPVDSGFWWIILLRAYTKSTGDLSLSETTECQKGMRLILSLCLSEGFDTFPTLLCADGCSMIDRRMGVYGYPIEIQALFFMALRSALAMLKHDTEGKEFIERIVKRLHALSYHMRSYFWLDFQQLNDIYRYKTEEYSHTAVNKFNVIPDSIPEWVFDFVPTRGGYFIGNVSPARMDFRWFALGNCIAILSSLATPEQASAIMDLIESRWEELVADMPLKICYPAIENHEWRIVTGCDPKNIRWSYHNGGSWPVLLWLLTAACIKTGRPQIARRAIDLAESRLLKDSWPEYYDGKLGRYIGKQARKHQTWSIAGYLVAKMLLEDPSHLGMISLEEDKQMKPVIKRSSSWTF

SEQ ID NO: 3079 - protein, 559 aa, Triticum aestivum
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQVFVRDFVPSAMAFLMNGEPEIVKNFLLKTVLLQGWEKKVDRFKLGEGAMPASFKVLHDDKKGVDTLHADFGESAIGRVAPVDSGFWWIILLRAYTKSTGDLTLAERPECQKAMRLILSLCLSEGFDTFPTLLCADGCCMIDRRMGVYGYPIEIQSLFFMALRCALLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIARRAIDLAERRLLKDGWPEYYDGKLGKYVGKQARKFQTWSIAGYLVAKMLLEDPSHLGMIALEEDKAMKPVLRRSASWTN

SEQ ID NO: 3080 - protein, 188 aa, Hordeum vulgare
MASSTALSPVAFKSSFSPLSFRPARTRINAQGAFCLPCSTWKRSSNRSFRVYSLFGGKKEKDENGDEAPAKGGIFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGDGLK

SEQ ID NO: 3081 - protein, 187 aa, Lolium multiflorum
MASSTALSPVAFKSSFSPLSSNSPRRINVQGAFCLPCSTWKRASNRSFRVYSLFGGKKEKDENGDEAPSKGGLFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGDGLK

SEQ ID NO: 3082 - protein, 186 aa, Zea mays
MAPSAALAPVAFRSAFSTPLASNPTRNRINIEGTFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMSDLAQSLGMPAGLGDGLK

SEQ ID NO: 3083 - protein, 159 aa, Pennisetum glaucum
RINIEGGFCSPCSTRKRASYRPFRVYSLFGGKKDKDDNGDEAPSKAGIFGNMQNLYETVKKAQMVVQVEAVRVQKELAATEIDGYCEGELIKVTLSGNQQPIRVEITEAAMEFGAEKLSELVNDAYKDAHSRSVQAMKERMADLAQSLGMPAGLGDGLK

SEQ ID NO: 3084 - protein, 185 aa, Oryza sativa
MAPSTALSPVAFKSSFSPLLFNPTRSKINVEGAFCLPCYNRKKASNRSFRVYSLFGGKKDKDENGEEAPSKAGIFGNMQNLYETVKKAQMVVQVEAVRVQKELAATEIDGYCEGELIKVTLSGNQQPVRVEITEAAMEVGAEKLSELVNDAYKDAHQRSVQAMKERMADLAQSLGMPAGLGDGLK

SEQ ID NO: 3085 - protein, 185 aa, Sorghum bicolor
MAPSAALAPAAFRSAFSTPLASNPTRNRINIEGAFCLPCSTRKRASYRPFRVYSLFGGKKDKDENGDEPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMADLAQSLGMPAGLGDGLK

SEQ ID NO: 3086 - protein, 186 aa, Saccharum officinarum
  misc_feature (17)..(17): Xaa can be any naturally occurring amino acid
  misc_feature (22)..(22): Xaa can be any naturally occurring amino acid
  misc_feature (32)..(32): Xaa can be any naturally occurring amino acid
MAPSAALAPAAFRSAFXTPPAXNPTRNKINIXGAFCLPCSTRKRASYRPFRVYSLFGGKKDKDENSDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMADLAQSLGMPAGLGDGLK

SEQ ID NO: 3087 - protein, 186 aa, Panicum virgatum
MAPSAALAPVAFRSAFSPPLSSNPTRNRINIEGALCLPCSTRKRASYRSFRVYSLFGGKKDKDENSDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMADLAQSLGMPAGLGDGLK

SEQ ID NO: 3088 - protein, 186 aa, Panicum virgatum
MAPSAALAPVAFRSAFSPPLSSNPTRNRVNIEGALCLPCSTRKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMADLAQSLGMPAGLGDGLK

SEQ ID NO: 3089 - protein, 188 aa, Triticum aestivum
MASSTALSPVAFKSSFSPLPSRPARTRINVQGAFCLPCSTWKRANNRSFRVYSLFGGKKEKDENGDEAPSKGGIFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGDGLK

SEQ ID NO: 3090 - protein, 188 aa, Triticum aestivum
MASSTALSPVAFKSSFSTLPSRPARTRINVQGAFCLPCSTWKRASNRSFRVYSLFGGKKDKDENGDEAPSKGGLFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGDGLK

SEQ ID NO: 3091 - protein, 496 aa, Zea mays
MGSVPPAEGDRRQPQQQPHVVMIPYPAQGHVTPMLQLAKLLHTRGFHVTFVNNEFNHRRHLRARGPGALHGAPGFRFTAIDDGLPPSDADATQDVPKLCYSTMTTCLPRFRDLIVRTNAEAEAEGRPAVTCVVADSIMSFGLRAARELGLRCATFWTASACGFIGYYYYRHLVARGIVPLKNEAQLTDGYLDTVVDWIPCAPKDLQLRDFPSFVRTTDPDDIMLNFFIHEVEAMSQASAVVINTFDDLDATLLHAMAKLLSRPIYTVGPLLLTVRNNVPADSPVAAIGSNLWKEQEAPLRWLDGRAPRSVVYINFGSVTVMSNEQLVEFAWGLANTGYTFLWNVRPDLVKGGDSAGAGLPPEFLAATEGRSMLSTWCPQAEVLEHEAVGLFLTHSGWNSTIESICGGVPMVCWPFFAEQQTNCRYKRTEWGIGMEIGNDVRRGEVKALIREAMEGEKGRDMRRRVTELKGSAVAAAKLNGRSMRNVDRFIDEVLLA

SEQ ID NO: 3092 - protein, 515 aa, Zea mays
MSGMSDSAGGGRAGAELMVEQFHLKVLHAVLAVRTPRPLAAAAAAASSSSSFRRRDRWFHLPLHDPPPPEAAGRLDELAPGQPRVVDVLLCPATASGVGDRGEVVERWTVACEPWPDAASGEEVAVNRAYKHCFTLLRSVYAALRVLPAYRVFRLLCANASYNYEMGHHVDTFAEPFSRPQEAAMRSQRFVPVETQLGRLVVSVHYLPSLAGVAAFNLEITPLSPSMIIPDYVGSPAAEPMRTFPASLTEATGSGFPPSYEQQRPHSWASPAFWPHTPAHQARFSPPPVFYASPTPSPPHFPPGLMRWESAPMPIPQVSERRSPAHLQNMLPPPSPRRADTGAAGALEFPSESGRLIGRMEELRLADLHATSSPRHKGKDNKDESGRFSALSSCDSPRQDDLDDVDYHFDVDDVDTPVSQPRSTSGKETGDQVGSLPHKSQDAQVGYLVNLLRNARPLRNPSNPSQTPRAQSTRVTSASSVTTSDALEVLQSFKETRERLLSRSSAKHQEPPGKP

SEQ ID NO: 3093 - protein, 508 aa, Sorghum bicolor
MSGMSDSGGGVRAGAELMVEQFHLKVLHAVLAVRTPRPLAAAAASFRRRDRWFHLPLHDPPPPPEAADRLDELAPGEPLVVDVLLCPAGGVGARGEVVERWTVACEPWPDAAGGEEVAVNRAYKHCFTLLRSVYAALRVLPAYRIFRLLCANPSYNYEMGHRVDTFAEPFSRPQEAAMRSQRFVPVETQLGRLVVSVQYLPSLAAFNLEITSLSPSVIIPDYIGSPAAEPMRAFPASLTEATGSGFPPSYQQQRPHSWASPAFWPHTPAHQARFSPPPVFYASPTPSPPHFPPRLMRWESAPMPIPQVSERRSPAHRQNMLPPPSPRRGDMGAAGALESPSESGRLIGRMEELRIADPYATSSPRHKGKDNKDESGRFSALSSCDSPRQDDLDDVDYHFDVDDVDTPVSQPRSADGKETGDQVGSSSHKSQDAQVGSLVNLLRNACPLRNPSNSSQTSRAESSEVASASSVTSRRTSDALEELQSFKEIREQLLARSSSKHQEPPGKP

SEQ ID NO: 3094 - protein, 499 aa, Panicum virgatum
MSGMSDSAGGGRAGAELMVEQFHLKVLHAVLAVRTPRPLAAAAAAPAAASAFRRRDRWFHLPLHDPPPPPEAADRLEPLAPGEPLVVDVLLSPAGGGAGPGGEVVERWTVACEPWPDAAGGEEVAVNRAYKHCFTLLRSVYAVLRVLPAYRVFRLLCANHSYNYEMVHRVDTFAEPFSRAQEAAMRSHRFVPVETQLGRLVVSVQYLPSLTSFNLEITSLSPSNIIPDYVGSPAAEPMRAFPASLTEATGSAFPSSYQLQRPHSWAPPVFWPHTPAQQVFYASPTPSPPHFPGGYLQKRLTRGESAPMPIPQVGERRSPVHRQNTLPPPSPRKGDMGAAGAQESPSEIGRLIGRLSPRHKGKDNKDESGRFSALSSCDSPRQDDLDDYPFFVDDVDPPVSKPGSSDGKETSDQACSLSHKSQDAQVGSLVNLLRNACPLRDPSYSLQTSRAEPSEAASASSATSRRTSDALEELQSFKEIRERLQSRSSAKHQEPPGKP

SEQ ID NO: 3095 - protein, 177 aa, Zea mays
MSAPNSDSNMQQLVPIAPPGKASGGDSGKELVVADPAGKRSGGVKLREDEEDLEVKLRRIMENVPVRVSNTSGSSAGSGSGDFHQYRQMRRREQDRLARMDADYQKRKEIAEFELRREERMKAAEERTAKKRLKRQKKKQRKKEKRAKTGDNGGEEPNRVESSDDDEGSDDDDKSKQ

SEQ ID NO: 3096 - protein, 175 aa, Oryza sativa
MSDPGRDSNMQQLIPIAPPPKASSGTTGKELVVVDGTGKASGGVKLREDEEDLEVKLRRIMENVPVRVSNTSGSSAGSGSGDFHQYRQMRRREQDRLARMDADYQKRKQMAEFELRREERLKEAEERTAKKRLKRQKKKQRKKEKKRSKTNNGGEQPNGGESSGGDEDSDDEDKP

SEQ ID NO: 3097 - protein, 177 aa, Sorghum bicolor
MSAPNSDSNMQQLVPIAPPGKASGADSGKELVVADPGGKSSGGVKLREDEEDLEVKLRRIMENVPVRVSNTSGSSAGSGSGDFHQYRQMRRREQDRLARMDADYQKRKEMAEFELRREERIKAAEERTAKKRLKRQKKKQRKKEKRAKTGNNGGEDPNRVDSSDDDEGSDDDDKSKQ

SEQ ID NO: 3098 - protein, 179 aa, Sorghum bicolor
MSALNSDSNMQQLVPIAPPGEASCGGDSGKELVVVDPAGKSSGGVKLREDEEELEVKLRRIMENAPVRVSNTSGSSAGSGSGDFHQYRQMRRREQDRIARMDADYQKRKEMAEYELRRVERLKAAEERTAKKRLKRQKQKQRKKEKRAKTDNNGGEKPNRVESSDEDEGSDDDDGKSTR

SEQ ID NO: 3099 - protein, 176 aa, Panicum virgatum
MATPNRDSNMQQLVPIAPPGKASGSDTGKELVVVDPAGKGSGGVKLREDEEDLEVKLRRIMENVPVRVSNTSGSSAGSGSGDFHQYRQMRRREQDRLARMDADYQKRKELAEFELRREERLKAAEERTAKKRLKRQKKKQRKKEKRTKTGNGGEEPNRVESSDDDEGSDDDGESKQ

SEQ ID NO: 3100 - protein, 177 aa, Panicum virgatum
MATPNRDSNMQQLVPIAPPGKASGSDTGKELVVVDPAGKGSGGVKLREDEEDLEVKLRRIMENVPVRVSNTSGSSAGSGSGDFHQYRQMRRREQDRLARMDADYQKRKEMAEFELRREERLKAAEERTAKKRLKRQKKKQRKKEKRTKTGNGGEEPNRVESSDDDEGSDDDDGKSKQ

SEQ ID NO: 3101 - protein, 346 aa, Hordeum vulgare
MRAAATSTAISLLSPSHLRTSAAASLPYRRRPRIAAMAAAASSFRPEAARSPAAVEPPAPPLSKFKVALCQLSVTADKARNIARARAAIESAAADGAKLVLLPEIWNGPYSNDSFPEYAEDIEAGGDAAPSFSMMSDVARSLQITLVGGSISERSGNSLYNTCCVFGSDGKLKGKHRKVHLFDIDIPGKITFQESKTLTAGQDLTVVDTDVGRIGIGICYDIRFQELAMLYAARGAHLLCYPGAFNMTTGPLHWELLQRARAADNQLFVATCAPARDTGSSYVAWGHSTLVGPFGEVIATTEHDEATIIAEIDYSLIEQRRQFLPLRHQRRGDLYQLVDVQGSGSK

SEQ ID NO: 3102 - protein, 356 aa, Zea mays
MRAAAAATSTAAALLAPGLKLCAGGARARVSCPSRSRLPLHRIAAMASAPNPSFRPEEARSPPALELPTPPLSKFKVALCQLSVTADKNRNIAHARAAIEKAASEGAKLVLLPEIWNGPYSNDSFPEYAEDIEAGGDAAPSFSMMSEVARSLQVTLVGGSIAERSGNNLYNTCCIFGSDGKLKGKHRKIHLFDIDIPGKITFKESKTLTAGQNPTVVDTDVGRIGIGICYDIRFQELAMLYAARGAHFLCYPGAFNMTTGPLHWELLQRARATDNQLFVATCGPARDTSAGYVAWGHSTLVGPFGEVIATTEHEEATIIAEIDYSLIEQRRQFLPLQHQRRGDLYQLVDVQRLGSH

SEQ ID NO: 3103 - protein, 351 aa, Oryza sativa
MRATAAAAFSLLTCSCLRSTSPTRLPSSSLRLPLRRGPLAAMATAASFRPEAARSPPAVQPPAPPLSKFKVALCQLSVTADKARNIARAREAIEAAAAGGAKLVLLPEIWNGPYSNDSFPEYAEDIEAGGDAAPSFSMMSEVARSLQITLVGGSISERSGNKLYNTCCVFGSDGELKGKHRKIHLFDIDIPGKITFKESKTLTAGQDLTVVDTDVGRIGIGICYDIRFQELAMLYAARGAHLLCYPGAFNMTTGPLHWELLQRARAADNQLFVATCAPARDTSAGYIAWGHSTLVGPFGEVIATAEHEETTIMAEIDYSLIDQRRQFLPLQYQRRGDLYQLVDVQRSGSDE

SEQ ID NO: 3104 - protein, 353 aa, Sorghum bicolor
MRAAAAAAATSTAAALLAPGLKLCAGRARVSSCRLPLRRVAAMASAPNSSFRPEEARSPPALELPTPPLSKFKVALCQLSVTADKSRNIAHARAAIEKAASDGAKLVLLPEIWNGPYSNDSFPEYAEDIEAGGDAAPSFSMMSEVARSLQITLVGGSIAERSGNNLYNTCCVFGSDGQLKGKHRKIHLFDIDIPGKITFKESKTLTAGQSPTVVDTDVGRIGIGICYDIRFQELAMLYAARGAHLLCYPGAFNMTTGPLHWELLQRARAADNQLFVATCGPARDTSAGYVAWGHSTLVGPFGEVIATTEHEETTIIADIDYSLIEQRRQFLPLQHQRRGDLYQLVDVQRLGSN

SEQ ID NO: 3105 - protein, 352 aa, Saccharum officinarum
  misc_feature (9)..(9): Xaa can be any naturally occurring amino acid
MRAAAAATXTAAALLAPGLKLCAGRARVSCPYRLPLHRVAAMASAPNSSFRPEEARSPPALELPTPPLSKFKVALCQLSVTADKSRNIAHARAAIEKAASDGAKLVLLPEIWNGPYSNDSFPEYAEDIEAGGDAAPSFSMMSEVARSLQITLVGGSIAERSGNNLYNTCCVFGSDGQLKGKHRKIHLFDIDIPGKITFKESKTLTAGQSPTVVDTDVGRIGIGICYDIRFQELAMLYAARGAHLLCYPGAFNMTTGPLHWELLQRARAADNQLFVATCGPARDTSAGYVAWGHSTLVGPFGEVIATTEHEEVTVIADIDYSLIEQRRQFLPLQHQRRGDLYQLVDVQRLGSQ

SEQ ID NO: 3106 - protein, 350 aa, Triticum aestivum
SPDESRGHIHSLLPPLALPPPDLRSHHHQPPLPPSSPHRRHGHRRRLLPPGGRALAPRRRAPGPAALQVQGGAVPVSVTADKARNIARARAAIESAAADGAKLVLLPEIWNGPYSNDSFPEYAEDIEAGGDAAPSFSMMSDVARSLQITLVGGSISERSGNSLYNTCCVFGSDGKLKGKHRKVHLFDIDIPGKITFQESKTLTAGQDLTIVDTDVGRIGIGICYDIRFQELAMLYAARGAHLLCYPGAFNMTTGPLHWELLQRARAADNQLFVATCAPARDTSSSYVAWGHSTLVGPFGEVIATIEHDEATIIAEIDYSLIEQRRQFLPLRHQRRGDLYQLVDVQGSGSK

SEQ ID NO: 3107 - protein, 625 aa, Zea mays
MDNGFMDIPHPPLMNDPFVLVGCSAPSSTVENMGQSTLCMDGLNPAIVNCSHVNGNTQIMNDITARDDGSRLVLGLGPTPNFYSAVSTGSKQAQRLSGQSSTFTDSGMLRLGLHTDGGGAIQCLQAPNGALHSLGIVDEASTSTTVRSMGGYMPSLLFAPRSNPTVNETQVEIPDSLNLTHSTSNSQHIQRHLQFSPEPSAMTESSFGVSSDVVTATTTSERSHSRHPKKCRFKGCSKGARGASGLCIAHGGGQRCHKPGCHKGAESSSAYCKAHGGGRRCEELGCTKSAEGKTDYCIAHGGGRRCEHPGCPKAARGKSGRCIKHGGGKRCLVKGCIRSAEGKAGLCISHGGGRRCQYPDCGKGAQGSTLYCKGHGGGKRCVFDGCSKGAEGSTPLCKAHGGGKRCMFEGGGVCAKSVHGATEYCVAHGGGKRCSVPGCTKSARGRTDCCVKHGGGKRCKVENCGKSAQGSTDFCKAHGGGKRCTWGTGCEKFSRGKSGFCAAHGTLMARQREQEAAKNVGSMIGPGLFSGIVVSSATAASSMTNEHSSSGVSTASDCDGTVRSQSMIPPQVLVPRSMMPSWSTEPVDGGREGGHVVPEGRVHGGGLLSLIGGSFRNADLEKLQS

SEQ ID NO: 3108 - protein, 626 aa, Sorghum bicolor
MDNGFVNIPHPPLSEALMNDPFVLVGCSAPSSTMENMGQSTLCMDGLNPAMVSCSHVNGNTQIMNDIAPRDDGSRLVLGLGPTPNFYSAASTGSKQDQRLSGQSSTFTDSGMLRLGLQMDGGEAIQYLQAPNGALHSLGVVDEASTSATVRNMGGYMPSLLFAPRANSTVNETQVETPDSLDLTHSTSNSQHVQHHLQLSPEPSAMTESSFGVSSDVVTATTTSERSHSRHPKKCRFKGCSKGARGASGLCIAHGGGQRCHKSGCHKGAESSSAYCKAHGGGRRCEELGCTKSAEGKTDYCIAHGGGRRCEHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVAHGGGKRCSVPGCTKSARGRTDCCVKHGGGKRCKVDNCGKSAQGSTEFCKAHGGGKRCTWSTGCEKFSRGKSGFCAAHGTLMARQREQEVVKNVGSMIGPGLFSGIVVSSATAASSMTNEHSSSGVSTASDCDGTMRSQSMIPPQVLVPRSMMPWSSEPVDGGREGGHVVPEGRVHGGGLLSLLGGSFRNADVEKL

SEQ ID NO: 3109 - protein, 256 aa, Panicum virgatum
MESTSPNAASSSRQLSSSMGLADKFCCLSREDVLRFLIGCLGALAPIPLTQISSLGVINPQYCYVEASAPAMEAIEKIPQDPCAVAVVETMPDGTRKILGDISTYKLWKCDYVSAAWALANLSAGQFVIGADENAAMSMSVLPEPPVSPSSPVEEISPGRSPRAKKFSSRSIGFQANQMSAWRMRSSFHRGRSTPLTCKSTSTLAAVMAQMLSHRATHVWVTDAESEEDGVLVGVVGYTDIFNAATRSTCSSPTTS

SEQ ID NO: 3110 - protein, 242 aa, Sorghum bicolor
MGCEEEERLLFPSFVFPESFAEAATPGSGGEQKKARQRRRRKPRPAADGGEGGDEQAKKRRLSDEQARFLELSFRKERKLETPRKVQLAAELGLDAKQVAVWFQNRRARHKSKLMEEEFSKLRAAHDAVVLQNCHLETELLKMKDRLEEAEEEKRKVIAAAAAAGGGGGGAGAGSSSPSSSSFSTVTHNPAALVGQFGVDPEEAAADLTYMSEYAYNSYMNMMDMDLAPGGYFGGVVYDHFN

SEQ ID NO: 3111 - protein, 240 aa, Saccharum officinarum
  misc_feature (8)..(8): Xaa can be any naturally occurring amino acid
MGCEEEEXLLFPSFVFPESFAEAATPGSGDSGEQKKARQRRRRKPRPAADGGEAGDEQAKKRRLSEEQARFLELSFRKERKLETPRKVQLASELGLDAKQVAVWFQNRRARHKSKLMEEEFSKLRAAHDAVVLQNCQLETELLKMKDRLAEAEEEKTKLIAAAAAAGGVGAGAAGSSSPSSSSFSTVTHHPAALVGQFGVDPEEAAADLTYMSEYAYNNYMNMMDLAPGYFGGVVYDHFN

SEQ ID NO: 3112 - protein, 232 aa, Panicum virgatum
  misc_feature (97)..(97): Xaa can be any naturally occurring amino acid
MGCEEDERLLFPSFAFPAESFAEADTPGSGGEQKKARQRRRRKPRPAGEGDGGDELSKKRRLNDEQARFLELSFRKERKLETPRKVQLAAELGLDAXQVAVWFQNRRARHKSKLMEEEFSKLRAAHDAVVLQNCHLETELLRMKERLAEAEEEKRKLIAAAAAAAAGAGSSSPSSSSFSTVTHHPAALVGQFGVEAEEAADLAYMSEYAYNSYMNMMDLAPGYFGGVYDHFN

SEQ ID NO: 3113 - protein, 502 aa, Brachypodium distachyon
MGIVRPADDVESGVVGAGGGGGEVTAPLLLRDHKDDAAAVEDAKIQVDEKVDSCGGGPEGSIWMVLLSTAVAVCGSFEFGTCVGYSAPTQSGIVDEVGLSISEFAIFGSVLTIGAMIGAVTSGRLADFVGRKMTMRISATICIFGWLSIYFAKGATMLYFGRTLLGYSTGVLSYVVPVFIAEIAPKNLRGGLATSNQLLICSGSSATYITGALVAWRNLVLVGILPCVLLLAGLFFIPESPRWLANVGREKEFHTSLQKLRGEKADISEEAIEIKEHIESVQSFPKARVQELFLSKNIYAVIVGVGLMIFQQLGGINGVGFYASYIFTSAGFSGKLGTILIGIIQIPITLFGAILMDRSGRRVLLMVSASGTFLGCFMTGISFYLKAHGLFLEWVPALAVSGILVYIGAYSIGMGPVPWVIMSEIFSIKMKAIGGSLVTLVSWFGSFVISYSFSFLMDWSSAGTFFMFSAASMLTILFVVRLVPETKGRTLEEIQDSLNSRR

SEQ ID NO: 3114 - protein, 515 aa, Oryza sativa
MGIVRAAEDVEGAVVAGAAGGGGGGGGGEVTAPLLLRQHKQGRGDEEKIQNDAGGDGGGRRGGGGGGSMSMLMLSTAVAVCGSFEFGTCVGYSAPTQSGIVDEVGLSISQFALFGSVLTIGAMIGAVTSGRLADFLGRKMTMRISATICIFGWLSLHLAKGVIMLYFGRILLGFSTGILSYVVPVFIAEIAPKNLRGGLATSNQLLICSGSSATYIIGALVAWRNLVLVGIVPCVLLLTGLLFIPESPRWLANVGREKEFHASLQMLRGEDADVSEEAVEIKEYIESLHRFPKARVQDLFLRKNIYAVTVGVGLMIFQQLGGINGVGFYASSIFTSAGFSGKLGTILIGIIQIPITLFGAILMDKSGRRVLLMVSASGTFLGCFLTGISFYLKAQGLFSEWVPELALTGILVYIGAYSIGMGPVPWVVMSEIFSIDMKAIGGSLVTLVSWLGSFAISYSFSFLMDWSSAGTFFMFSAASLITILFVVMVVPETKGRTLEEIQDSLIDSRSRLRDP

SEQ ID NO: 3115 - protein, 505 aa, Sorghum bicolor
MGIVRAADDVEAGVVGAATTTTTTEPLLLRHCGKEDHDKIRGSPEEAAASDCGSEEGRPDAAGSLRMVLLSTAVAVCGSFEFGTCVGYSAPTQSGIVDEVGLSISEFAIFGSILTVGAMVGAVTSGRLADFLGRKMTMRISATICIFGWLSIHLAKSAIMLYFGRILLGFSTGVLSYVVPVFIAEIAPKNLRGGLATSNQLLICSGSSATYIIGALVAWRNLVLVGLLPCVLLLAGLYFIPESPRWLANVGREKEFHTSLQKLRGQDADVSEEAIEIKEYIESLRSFPKARLQDLFLSKNIYAVIVGVGLMVFQQLGGINGVGFYASYIFSSAGFSGKLGTILIGIIQIPITLFGAILMDRSGRRVLLMVSASGTFLGCFLTGVSFYLKAQGLFPEWVPTLALSGILVYIGAYSIGMGPVPWVVMSEIFSINMKAIGGSLVTLVSWLGSFAISYSFSFLMDWSSAGTFFMFSAASLVTVFFVAKLVPETKGRTLEEIQDSLNTRR

SEQ ID NO: 3116 - protein, 586 aa, Brachypodium distachyon
MALARTLPLPHLAPAPASPGRLRGCIRVLPALSSQAGAPPAARGIACRSSKATTMTTTAAEVAAVGVGEELPEGYEQMMPTVEESRRRRAGVLLHPTSLRGPHGIGDLGDEALAFLHWLRDAGCTLWQVLPLVPPGRKSGEDGSPYSGQDANCGNTLLISLEELVKDGLLMEDELPAPLDVEYVEFDTVANLKEPLIAKAAERLLLSHGELRMQYDEFKRNPDISGWLEDAALFAAIDKSIDALSWYEWPEPLKNRHLGALEDIYQKQKDFIEIFMAQQFLFQKQWQRVRTHAQKLGISIMGDMPIYVGYHSADVWANRKSFLLDKNGFPTFVSGVPPDAFSETGQLWNSPLYDWKFMEADGFTWWVKRIKRALDLYDEFRIDHFRGLAGFWAVLSDAEVAMVGSWRAGPRNAFFDALFKAVGRANIIAEDLGVITGDVVELRKSIGAPGMAVLQFAFSGGSGNPHLPHNHELNQVVYTGTHDNDTVVGWWKSLPEEEKQTVLKYLPEASKTDVSWALITTALSSVARTSMVTMQDILGLDSSARMNTPATQKGNWRWRIPSSVSFDSLNPEAAKLKELLAFYSRL

SEQ ID NO: 3117 - protein, 608 aa, Sorghum bicolor
MVLARVLTLPLPAPSSAPHRRLLLPPQASPAPARVRTVRAAACRAANAMAAVSVDPPPVAPSPAEVAAVGVGDELPEGYDQMMPTVEPSRRRRAGVLLHPTSLRGPHGIGDLGDEALAFLHWLRDAGCTLWQVLPLVPPGRTAGEEGSPYSGQDANCGNTLLLSLEELVKDGLLMSDELPDPVDTEYVEFDTVANLKEPLIAKAAERLLLSHGELRTQYDCFKKNPNISGKNFLCINFQTMFISLSYCWLEDAALFAAIDKSIGAFSWYEWPEPLKNRHLGALEDIYQKQKDFIETFMAQQFLFQRQWQRVRKYAQKLGISIMGDMPIYVGYHSADVWANRKSFLLDKNGFPTFVSGVPPDAFSETGQLWNSPLYDWKAMEADGFSWWTKRIKRALDLYDEFRIDHFRGLAGFWAVPSDAKVALVGSWRAGPRNSFFDALFKAVGRINIIAEDLGVITEDVVQLRKSIGAPGMAVLQFAFGGGSDNPHLPHNHEMDQVVYTGTHDNDTVLGWWQNLPEEEKKIVIKYLPEAENTDISWTLITAALSSVARTSMVTMQDILGLDSSARMNTPATQKGNWRWRMPGSVGFDSLSPEAAKLKELLALYNRQ

SEQ ID NO: 3118 - protein, 333 aa, Panicum virgatum
AVGVGEELPEGYDQMMPTVEPARRRRAGVLLHPTSLRGPHGIGDLGDEALAFLHWLRDAGCTLWQVLPLVPPGRTSGEDGSPYSGQDANCGNTLLISLEELVKDGLLMEDELPSSVDVEHVEFATVANLKEPLIAKAAERLLLGQGELRTQYDCFKKNPNISGWLEDAALFAAIDKSIGAFSWYEWPEPLKNRHLGALEDIYQKQKDFIETFMAQQFLFQRQWQRIRKYAQKLGISIMGDMPIYVGYHSADVWANRKSFMLDKNGFPTFVSGVPPDAFSETGQLWNSPLYDWKAMEADGFSWWIKRIKRALDLYDEFRIDHFPGACGFLGSPI

SEQ ID NO: 3119 - protein, 504 aa, Sorghum bicolor
MRPSSSIASSRGTAAPRMYFIPFPTPGHALPMADLARLFASRGADATLVLTRANAARLGGPVARAAAAGLRIRIIALTLPAEAAGLTGGHESADDLPNRELAGPFAIAVDLLAPLFADLLRRQPADAVVFDGVLPWAATAASELGIPRYAFTGTGCFALSVQRALLLHSPQNGVASDTEPFLVPGLPDAVRLTRSRLAEATLPGADSREFLNRMFDAERATTGWVVNSFADLEQRYIEHYEKDTGKPVFAVGPVCLVNGNGDDTLERGRGGEAETAVEAARVLRWLDTKPARSVVYVCFGSLTRFPRDQVAELGMGLADSGANFVWVVGDKNAPPPLPDIDGAAPGRGLVVRGWAPQVAVLRHAAVGAFVTHCGWGAVTEAAAAGVPVLAWPVFAEQFYNEALVVGLAGTGVSMGAERGYVWGGEALGGVVVGREAVAERVRSAMAGEALRGRAREVGERARRAVEAGGSSYEAVGALLEDVLRRLNTYATARTPGRGGRGGMP

SEQ ID NO: 3120 - protein, 484 aa, Sorghum bicolor
MGELQERKPPASCTAARPRVLLLCSPCMGHLIPFAELARRLVADHGLAATLLFASATSAPSEQYLALAAAVPDAVDLVALPAPPPVAALPPSVPTRERVQLAVVSNVPRVREIARELGAAAPLVALVVDMVAVVARDVAEELGVPFYTFFTSPWMTLSLFLHLPEIDAACAGEHRDATEPIRLPGCVPIHAHDLPTSMLADRSSDTYAGFLSMAKDAARVDGILVNTFHELEPAVGDGLQLQLPVHPIGPLVWTRPVGVDNDHKCMSWLDQQPRGSVVYVSFGSGGTLTWQQTAELALGLELSQCRFIWVVKRPHQSSTVGAFFGTQKDDDEHIPLDFLPEGFMERTRGMGLVTQSWAPQTAILGHPSIGCFVTHCGWNSVLESVMNGVPMVAWPLYAEQNMNAAMMDVQIGVAVQAKVGVDRFIRKEEVANSIQRVMIGDEAERLRKRSSELRGQSAHALSKDGCSTRVLAQIANTWKCASRK

SEQ ID NO: 3121 - protein, 307 aa, Sorghum bicolor
MDAGGGGVLAAVLCMLLVFAIFPLLLWRRRSDAATADNHRHPPQPLQEDQVLHGRAAARRMRRRPGAAGAGSSAASTSRNVVEDDAESDEEEVPEGRNVPRSSKKEKKRQEREAQRQAEEAARDSRRSKQDRYDEMRRKKDEEREAQERQLEEEARARKTKEEEAAALEFEKWKGAFSVDAEGTTESETQDDGQGLLHNFVEYIKKQKCVPLEDLAAEFRMRTQDCINRIVTLESMDRLSGVMDDRGKFIYISTEEMKAVAEYIRKQGRVSISHLANNSNQFIDLEPKAQYEEERQQDDSAAAGTEP

SEQ ID NO: 3122 - protein, 306 aa, Saccharum officinarum
MDAGGGGVLAAVLCMLLVFAIFPLLLWRRRSDAATADNHRAPPQPLQEDQVLHGRAAARRMRRRPGAAGAGSSAASTSRNVVEDDAESDEEEVPEGRNVPRSSKKEKKRQEREAQRQAEEAARDSRRSKQDRYDEMRRKKDEEREAQERQLEEEARARKAKEEEAAALEFEKWKGAFSVDAEGTTESETQDDGQGLLHNFVEYIKKQKCVPLEDLAAEFRMRTQDCINRIVTLESMDRLSGVMDDRGKFIYISTEEMKAVAEYIRKQGRVSISHLANNSNQFIDLEPKAQYEESQQDDSAAAGTDP

SEQ ID NO: 3123 - protein, 306 aa, Panicum virgatum
MDAGGGGVLGAVLCMLLVFAIFPLLLWRRRSDAAASASADNHRLPPQPLQEDQVLHGRAAPRRMRRRPGAASSSAASTSRDVPEEDEEGDDEEVQDVPRSSKKKEKKRQEREAQRQAEDAARDSRRNKQDRYEEMRRRKDEEREAQERLLEEEARARKAKEEEAAALEFEKWKGAFSVDAEGTTESETQDDGQGLLHNFVEYIKKQKCVPLEDLAAEFRMRTQDCINRIVTLESMDRLSGVMDDRGKFIYISTEEMKAVAEYIRKQGRVSISHLANNSNQFIDLEPKAQYEEESHQDDSAAVDTDQ

SEQ ID NO: 3124 - protein, 509 aa, Brachypodium distachyon
MASDAKPDSPPAGVDPPPPKEEAKAEKEGEGEEPQSGGRKRGRRKKGEAEKEKEKPPPATPTIERPSRERKTVERYSELAPRVTPAKKSPAILQGSGSKLKDIPNIQFKLSKRKADENLQSLHVLMYGRKSNVHYLKRNIAQFSGFVWTDNQEKQRTRIKEKLDKFNKEKLLDFCEILDIHVSRAATKKEEVSAKLLEFLESPCITRDVVLTDDKKGKKRGRRSKGNGQATAEGASDGKKRRKSRKQSTEAAKENDDEDDEGPADSEDASMGEEDDEDSEAKDNAGSDEEPDEPPAKKKATDDKQTKKAKEKDATAKKASTRPAKGVSKPSQDTEEDDEPEVELESKKVVKKVSKSSKESDVTVDKTTKKASKSKKDEGKDGQNNNSGALNNKARKKDAAKTTNKNKGKGKGSTEAGAAPTTEELHAVVSDILKEVDFNTATLADILRQLGTHFKMDLMDRKSEVKHIIEEVINSMSDDEEGEEDNAEDDKDKNAKEENSKEDADGDEK

SEQ ID NO: 3125 - protein, 257 aa, Oryza sativa
MGGGAAASRVSSAMAVAVAAAAALVVMWAGTATAAAAVYEVGDKTGWTIMGSPNYTAWAASKKFHLGDTVVWELNSAYFNAPTVRLDCRSVLRVEQIGPLSNPTQELSNYTQPKKSRAVFTYNKQFHNVMAVSKSDYKNCDTSKPIATWSTGNDSVVLNATGHHYFLCGFPGHCGIGQKVDIRVAASGHSSAAPSMAPAPASGSEAPVAPGGGGGGSSGHAAAAAPSPHGNAAVGRSVFTAIAVSVLSVAAAGLKLI

SEQ ID NO: 3126 - protein, 412 aa, Malus domestica
MAFQKIKVANPIVEMDGDEMTRVFWKSIKDKLILPFVELDIKYFDLGLPHRDATDDKVTVESAEATLKYNVAIKCATITPDEARMKEFSLKSMWRSPNGTIRNILNGTVFREPILCKNIPRLIPGWTKPICIGRHAFGDQYRATDAVIKGPGKLKLVFVPEGKDEKTELDVYDFTGEGGVALAMYNTDESIRAFAEASMTTAYEKKWPLYLSTKNTILKKYDGRFKDIFQEVYEANWKSKFDAAGIWYEHRLIDDMVAYALKSDGAYVWACKNYDGDVQSDMLAQGFGSLGLMTSVLVCPDGKTIEAEAAHGTVTRHYRVHQKGGETSTNSIASIFAWTRGLAHRAKLDDNARLLEFTQKLEEACIGTVESGKMTKDLALILHGSKLARNHYLNTEEFIDAVAEELKAKLAC

SEQ ID NO: 3127 - protein, 412 aa, Malus domestica
MAFQKIKVANPIVEMDGDEMTRVFWKSIKDKLILPFVELDIKYFDLGLPHRDATDDKVTVESAEATLKYNVAIKCATITPDEARMKEFNLKSMWRSPNGTIRNILNGTVFREPIICKNIPRLIPGWTKPICIGRHAFGDQYRATDAVIKGPGKLKLVFVPEGKDEKTELEVYNFTGEGGVALAMYNTDESIRAFAEASMTTAFEKKWPLYLSTKNTILKKYDGRFKDIFQEVYEANWKSKFEAAGIWYEHRLIDDMVAYALKSDGGYVWACKNYDGDVQSDMLAQGFGSLGLMTSVLVCPDGKTIEAEAAHGTVTRHYRVHQKGGETSTNSIASIFAWTRGLAHRAKLDDNPRLLEFTQKLEEACIGTVESGKMTKDLALILHGSKLARNHYLNTEEFIDAVAEELKAKLAC

SEQ ID NO: 3128 - protein, 418 aa, Aquilegia formosa
MAFEKIKVANPIVEMDGDEMTRIFWKSIKDKLIFPFLDLDIKYFDLGLPHRDATDDKVTVESAEATLKYNVAIKCATITPDEARMEEFKLKSMWRSPNGTIRNILNGTVFREPIICKNVPRLVPGWTKAICIGRHAFGDQYRATDLVVRGAGKLKMVFVPEGQNEGTELEVYNFTGAGGVGLAMYNTDESIRSFAEASMATAYEKKWPLYLSTKNTILKKYDGRFKDIFQEVYEAQWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLSHRAKLDDNPRLLDFTEKLEAACVGTVESGKMTKDLALLIHGSKVSRDQYLNTEEFIDAVAEELKTRLSTKAKLSH

SEQ ID NO: 3129 - protein, 415 aa, arabidopsis lyrata
MEFEKIKVINPVVEMDGDEMTRVIWKFIKDKLIFPFLELDIKYFDLGLPNRDLTDDKVTIESAEATLKYNVAIKCATITPDEARVKEFGLKKMWRSPNGTIRNILNGTVFREPIICRNIPRIVPGWTKPICIGRHAFGDQYRATDIIVNEPGKLKLVFEPSGSSQKTEFEVFNFTGGGVALAMYNTDESIRAFAESSMYTAYQKKWPLYLSTKNTILKTYDGRFKDIFQEVYEANWRSKYEAAGIWYEHRLIDDMVAYAMKSEGGYVWACKNYDGDVQSDFLAQGYGSLGMMTSVLVCPDGKTIEAEAAHGTVTRHYRVHQKGGETSTNSIASIFAWSRGLAHRAKLDSNAALLSYTEKLEAACMGTVESGKMTKDLALLIHGPKVRRDQYVNTEEFIDAVAWELRRRLLGNSRL

SEQ ID NO: 3130 - protein, 208 aa, arabidopsis lyrata
MAFEKIKVANPIVEMDGDEMTRVIWKSIKDKLITPFVELDIKYFDLGLPHRDATDDKVTVESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVSMAMYNTDESIRAFADASMNTAYEKSGTLS

SEQ ID NO: 3131 - protein, 416 aa, Arabidopsis thaliana
MEFEKIKVINPVVEMDGDEMTRVIWKFIKDKLIFPFLELDIKYFDLGLPNRDFTDDKVTIETAEATLKYNVAIKCATITPDEARVREFGLKKMWRSPNGTIRNILNGTVFREPIICRNIPRLVPGWTKPICIGRHAFGDQYRATDLIVNEPGKLKLVFEPSGSSQKTEFEVFNFTGGGVALAMYNTDESIRAFAESSMYTAYQKKWPLYLSTKNTILKIYDGRFKDIFQEVYEANWRSKYEAAGIWYEHRLIDDMVAYAMKSEGGYVWACKNYDGDVQSDFLAQGYGSLGMMTSVLVCPDGKTIEAEAAHGTVTRHYRVHQKGGETSTNSIASIFAWSRGLAHRAKLDSNAALLSYTEKLEAACMGTVESGKMTKDLALLIHGAKVRRDQYVNTEEFIDAVAWELKRRLLGNNSRL

SEQ ID NO: 3132 - protein, 410 aa, Arabidopsis thaliana
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVAMAMYNTDESIRAFADASMNTAYEKKWPLYLSTKNTILKKYDGRFKDIFQEVYEASWKSKYDAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEAACVGTVESGKMTKDLALIIHGSKLSRDTYLNTEEFIDAVAAELKERLNA

SEQ ID NO: 3133 - protein, 412 aa, Artemisia annua
MGFEKIKVANPIVEMDGDEMTRIFWESIKNKLIFPFLELDIKYYDLGLLNRDATDDKVTVESAEATLKYNVAIKCATITPDEARMKEFTLKSMWRSPNGTIRNILNGTVFREPILCKNIPKLVPGWTKPICIGRHAFGDQYKATDAVIKGPGKLKMVFVPEGAGETIDLEVYNFTGAGGVALSMYNTDESIRAFAEASMNTAYLKKWPLYLSTKNTILKKYDGRFKDIFQEVYECNWKSKFEAAGIWYEHRLIDDMVAYALKSDGGYVWACKNYDGDVQSDMLAQGFGSLGLMTSVLVCPDGKTIEAEAAHGTVTRHYRVHQKGGETSTNSIASIFAWTRGLAHRAKLDDNAKLLDFTEKLEAACIGVVEAGKMTKDLALIIHGSKLSREHYLNTEEFIDAVADELKAKLSA

SEQ ID NO: 3134 - protein, 410 aa, Persea americana
MAFEKIKVANPIVEMDGDEMTRVFWKSIKDKLIFPFLELDIKYFDLGLPYRDSTDDRVTVESAEATLKYNVAIKCATITPDEVRVKEFNLKSMWKSPNGTIRNILNGTVFREPILCKNIPRLVPGWNKPICIGRHAFGDQYRATDTVIKGPGKLKLVFEGKEEQKELEVYNFTGAGGVALSMYNTDESIYSFAEASMNTAFEKKWPLYLSTKNTILKKYDGRFKDIFQEVYETKWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDNNARLLDFTQKLEAACIGTVESGKMTKDLALIIHGSNLTREHYLNTEEFIDAVAGELKSSLSC

SEQ ID NO: 3135 - protein, 412 aa, Brassica oleracea
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKTRLGVKA

SEQ ID NO: 3136 - protein, 412 aa, Brassica rapa; identical to SEQ ID NO: 3135

SEQ ID NO: 3137 - protein, 364 aa, Brassica rapa
MGLTEETQITPVQVTDDEAALFAMQLASASVLPMVLKTALDLDLLEIMAKNSSQMSPSEIASQLQTKNPEAPIMLDRILRLLTSYSILTCSSRTIPGGDSVERIYGLGPVCKYLTKNEDGVSIAALCLMNQDKVLMESWYHLKDAILDGGIPFNKAYGMSAFEYHGKDLRFNTVFNNGMSNHSTITMKKILETYKGFEGLTSLVDVGGGIGATLKMIVSKYPNLKGINFDLPHVIEEATSHPGIEHVGGDMFVSVPEGDAIFMKWICHDWSDKHCVKFLKNCYEALPEDGKVILAECILPETPDSSLSTKQVVHVDCIMLAHNPGGKERTEKEFERLAKESGFKGIKVACNAFGVYVIELLKKI

SEQ ID NO: 3138 - protein, 412 aa, Brassica rapa
MAFEKIKVANPIVEMDGDEMTRVIWKSIKDKLITPFVELDIKYFDLGLPHRDATDDKVTVESAEATKKYNVAIKCATITPDEGRVTEFGLKQMWRSPNGTIRNILNGTVFREPILCKNVPKLVPGWTKPICIGRHAFGDQYRATDAVIKGPGKLTMTFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKTRLGVKA

SEQ ID NO: 3139 - protein, 409 aa, Hordeum vulgare
MAFEKIKVANPIVEMDGDEMTRVFWQSIKDKLIFPFLDLDIKYFDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVAMAMYNTDESIRGFAEASLAIAYEKKWPLYLSTKNTILKKYDGRFKDIFQEIYEAGWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLEFAQKLEEACVGTVESGKMTKDLALLVHGSSKVTRSDYLNTEEFIDAVAAELKSRV

SEQ ID NO: 3140 - protein, 409 aa, Ocimum basilicum
MAFDKIKVASPIVEMDGDEMTRVIWQMIKDKLIFPFLELDIKYFDLGITHRDATDDKVTIESAEATLKYNVAIKCATITPDEARVKEFGLKQMWKSPNGTIRNILNGTVFREPILCKNVPRLIPGWTKPICIGRHAFGDQYRATDAVIKGPGKLKLVFVPESGEKTEMEVYDFTGAGGVALSMYNTDESIRSFAESSMNTAYLKKWPLYLSTKNTILKKYDGRFKDIFQEVYESQWKAKFEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTEKLEAACIGVVESGKMTKDLALIIHGSKLARSQYLNTEEFIDAVADELKAKL

SEQ ID NO: 3141 - protein, 412 aa, Phaseolus coccineus
MAFQKINVANPIVEMDGDEMTRVIWKSIKDKLILPFLELDIKYYDLGLPYRDETDDKVTTDSAEATLKYNVAIKCATITPDEARVKEFGLKQMWKSPNGTIRNILNGTVFREPILCKNIPRLVPGWTKAICIGRHAFGDQYRATDSVIKGAGKLTLVFVPEGGGEKTELEVFNFKGEGGVSLAMYNTDESIRSFAEASMTTALEKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEAACIGVVEAGKMTKDLALILHGSKLSREHYLNTEEFIDAVAAELRDKISA

SEQ ID NO: 3142 - protein, 414 aa, Brachypodium distachyon
MAFEKIEVANPIVEMDGDEMTRVIWKWIKAKLIFPFLDLDIKYFDLGLPNRDATGDKVTIESAEATLKYNVAIKCATVTPDEGRVKEFNLKAMWRSPNGTIRNILNGTVFREPIICKNVPRLVPGWTKPICIGRHAFGDQYRATDTVIRGPGKLKLIFDGIDEQIELDVFNFSGAGGVALSMYNTDESIRAFAEASMNVAYQKRWPLYLSTKNTILKKYDGRFKDIFQENYEAKWRGKFEDAGIWYEHRLIDDMVAYALKSDGGYVWACKNYDGDVQSDLIAQGFGSLGLMTSVLVCPDGRTIEAEAAHGTVTRHYRVHQKGGETSTNSIASIFAWSTGLAHRAKLDDNKRLLDFTQKLEAACVGTVESGKMTKDLALLIHGPNVTRDKYLNTVEFIDAVAEELRTRLSVKSKL

SEQ ID NO: 3143 - protein, 412 aa, Brachypodium distachyon
MAFEKIKVANPIVEMDGDEMTRVFWQSIKDKLIFPFLDLDIKYYDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKEETVDLEVFSFTGAGGVALSMYNTDESIQGFAAASMATAYDKKWPLYLSTKNTILKKYDGRFKDIFQEVYEAEWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLEFAQKLEDACVGTVESGKMTKDLALLVQGSSNVTRSHYLNTEEFIDAVAAELRTRLAAN

SEQ ID NO: 3144 - protein, 414 aa, Theobroma cacao
  misc_feature (385)..(385): Xaa can be any naturally occurring amino acid
MAFEKIKVVNPIVEMDGDEMTRVIWKSIKDKLIFPFLELDIKYFDLGLPYRDATDDKVTVESAEATLKYNVAIKCATITPDEARVKEFNLKQMWKSPNGTIRNILNGTVFREPIICKNVPRLVPGWTKPICIGRHAFGDQYRATDAVIKGPGKLKLVFVPEGQDEKTEWEVFNFTGDGGVSLAMYNTDESIRAFAEASMNTAYQKKWPLYLSTKNTILKKYDGRFKDIFQEVYEAKWKSKYEAAGIWYEHRLIDDMVAYAVKSEGGYVWACKNYDGDVQSDFLAQGFGSLGLMTSVLVCPDGKTIEAEAAHGTVTRHYRVHQKGGETSTNSIASIFAWTRGLAHRAKLDDNIRLLEFTEKLEAACIGAVESGKMTKDLALIIHGXKLARDQYLNTEDFIDAVAEELRARLSVKA

SEQ ID NO: 3145 - protein, 412 aa, Brassica napus; identical to SEQ ID NO: 3138

SEQ ID NO: 3146 - protein, 412 aa, Brassica napus
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKARLGVKA

SEQ ID NO: 3147 - protein, 416 aa, Brassica napus
  misc_feature (26)..(26): Xaa can be any naturally occurring amino acid
  misc_feature (41)..(41): Xaa can be any naturally occurring amino acid
MEFEKIKVANPIVEMDGDEMTRVIWXFIKDKLILPYLELDXKYFDLGLPNRDSTDDKVTTESAEATLKYNVAIKCATITPDETRVREFGLKKMWRSPNGTIRNILNGTVFREPIICRNIPRIVPGWTKPICIGRHAFGDQYRATDIVVNEPGKLKLIFEPSGSSRKTEFEVFNFTGAGGVALAMYNTDESIRSFAESSMYTAYQKKWPLYLSTKNTILKTYDGRFKDIFQEVYETNWRSKFEAAGIWYEHRLIDDMVAYAMKSEGGYVWACKNYDGDVQSDFLAQGYGSLGLMTSVLVCPDGKTIEAEAAHGTVTRHYRVHQKGGETSTNSIASIFAWSRGLAHRAKLDSNASLLNFTEKLEAACMGTVESGKMTKDLALLIHGSKVKRDDYVNTEEFIDAVAWELRKRLLGSSRL

SEQ ID NO: 3148 - protein, 413 aa, Brassica napus
MAFEKIKVANPIVEMDGDEMTRVIWKSIKDKLITPFVELDIKYFDLGLPHRDATDDKVTVESAEATKKYNVAIKCATITPDEGRVTEFGLKQMWRSPNGTIRNILNGTVFREPILCKNVPKLVPGWTKPICIGRHAFGDQYRATDAVIKGPGKLTMTFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFFDAVADELKQDSASKLK

SEQ ID NO: 3149 - protein, 412 aa, Brassica napus
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPIICKNVPKLVPGWTKPICIGRHAFGDQYRATDAVIKGPGKLTMTFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKTRLGIKA

SEQ ID NO: 3150 - protein, 414 aa, Manihot esculenta
MAFEKIKVANPIVEMDGDEMTRVFWKSIKDKLIFPFLELDIKYFDLGLPHRDATDDKVTVESAEATLKYNVAIKCATITPDEARVKEFNLKQMWKSPNGTIRNILNGTVFREPIICKNVPRLVPGWSKPICIGRHAFGDQYRATDTVIKGAGKLKLVFVPEGQDEKTELEVFNFTGDGGVALSMYNTDESICAFAEASMNTAYQKKWPLYLSTKNTILKKYDGRFKDIFQEVYEANWKSKFEAAGIWYEHRLIDDMVAYALKSEGGYVWACKNYDGDVQSDFLAQGFGSLGLMTSVLVCPDGKTIEAEAAHGTVTRHYRVYQKGGETSTNSIASIFAWSRGLAHRAKLDDNERLLDFTQKLEAACIGAVESGKMTKDLALLIHGPKVTRDQYLNTEEFIDAVAAELKAKLGITE

SEQ ID NO: 3151 - protein, 416 aa, Manihot esculenta
MAFEKIKVSNPIVEMDGDEMTRIIWKSIKDKLIFPFLDLDIKYFDLGLPNRDATNDKVTIESAEATLKYNVAIKCATITPDEDRVKEFHLKRMWKSPNGTIRNILNGTVFREPIICKNIPRLVSGWTKPICIGRHAFGDQYRATDTTIQGPGKLKLVFVPDGCGEKTEFEVFNFTGAGGVALSMYNTDESIRAFAEASMNTAYQKKWPLYLSTKNTILKKYDGRFKDIFQEVYESQWKSKFEAAGIWYEHRLIDDMVAYALKSEGGYVWACKNYDGDVQSDFLAQGFGSLGLMTSVLVCPDGRTIEAEAAHGTVTRHYRVHQKGGETSTNSIASIFAWSRGLAHRAKLDRNARLLDFTDKLEKACVGAVESGKMTKDLALLIHGPKVTRDQYLNTEEFIDAVAEELIARLSAKAKL

SEQ ID NO: 3152 - protein, 416 aa, Ricinus communis
MELDKIKVDNPIVEMDGDEMTRIIWKSIKTKLIFPFLDLDIKYFDLGLPNRDATDDQVTVESAEATLKYNVAIKCATITPDETRVKEFNLKRMWKTPNGTIRNILNGTVFREPIICKNVPRLVPGWTKPICIGRHAFGDQYRATDAIIQGPGKLKLVFVPGGRDEKTEFEVFKFTGAGGVALSMYNTEESIHAFAEASMSTAYQKKWPLYLSTKNTILKKYDGRFKDIFQEVYETRWKSKFQAAGIWYEHRLIDDMVAYAIKSEGGYVWACKNYDGDVQSDFLAQGFGSLGLMTSVLVCPDGRTIEAEAAHGTVTRHYRVHQRGGETSTNSIASIFAWSRGLAHRAKLDGNARLLEFTEKLEAACVGAVESGKMTKDLALLIHGPKVTRAQYLNTEEFIDAVAEELRLRLSAKAKL

SEQ ID NO: 3153 - protein, 413 aa, Ricinus communis
MAFEKIKVANPIVEMDGDEMTRIFWKSIKDKLIFPFLELDIKYFDLGLPHRDATDDKVTIESAEATLKYNVAIKCATITPDEARVKEFNLKQMWKSPNGTIRNILNGTVFREPIICKNVPRLVPGWTKPICIGRHAFGDQYRATDAVIKGAGKLKLVFVPEGQDEKTELEVYNFTGAGGVALSMYNTDESIRAFADASMNTAYQKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDDNARLLDFTEKLEAACIGVVESGKMTKDLALLIHGSKVTRDQYLNTEEFIDAVAADLAERLSKA

SEQ ID NO: 3154 - protein, 397 aa, Centaurea maculosa
  misc_feature (13)..(13): Xaa can be any naturally occurring amino acid
  misc_feature (24)..(24): Xaa can be any naturally occurring amino acid
  misc_feature (31)..(31): Xaa can be any naturally occurring amino acid
  misc_feature (45)..(45): Xaa can be any naturally occurring amino acid
  misc_feature (139)..(139): Xaa can be any naturally occurring amino acid
  misc_feature (150)..(150): Xaa can be any naturally occurring amino acid
  misc_feature (221)..(221): Xaa can be any naturally occurring amino acid
MEMNDSRLLGIIXNKLIFPFLDLXIKYYDLXLLNRDATDDKVTVXSAEATLKYNVAIKCATITPDEARMKEFTLKSMWKSPNGTIRNILNGTVFREPIMCKNIPKLIPGWTKPICIGRHAFGDQYKATDAVIKGPGKLXMVFVPEGQGEXVDLEVYNFTGAGGVALSMYNTDESITAFAEASMNTAYLKKWPLYLSTKNTILKKYDGRFKDIFQEVYERNXESKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTEKLEAACVGCVESGKMTKDLALILHGSELSREHYLNTEEFIDAVADDLKARLSAN

SEQ ID NO: 3155 - protein, 416 aa, Centaurea maculosa
  misc_feature (7)..(7): Xaa can be any naturally occurring amino acid
  misc_feature (72)..(72): Xaa can be any naturally occurring amino acid
  misc_feature (371)..(371): Xaa can be any naturally occurring amino acid
MAFDKIXVTNPIVEMDGDEMTRVFWQSIKDKLIFPFVELDIKYYDLGLPNRDATDDKVTVESAEATLKYNVXIKCATITPDEARMKEFTLKSMWKSPNGTIRNILNGTVFREPILCKNIPKLVPGWTKPICIGRHAFGDQYKATDAVIKGPGKLKMVFVPEGEGETTELEVYNFTGAGGVALSMYNTDESIRAFAEASMNQAYEKKWPLYLSTKNTILKKYDGRFKDIFQEVYESNWKSKFEAAGIWYEHRLIDDMVAYALKSDGGYVWACKNYDGDVQSDMLAQGFGSLGLMTSVLVCPDGKTIEAEAAHGTVTRHYRVHQKGGETSTNSIASIFAWTRGLAHRAKLDNNSKLLEFTEKLEAACIGTVEXGKMTKDLALILHGSKLSREHYLNTEEFIDAVATELKARLIGKSSL

SEQ ID NO: 3156 - protein, 247 aa, Castanea mollissima
MGFQKIKVANPIVEMDGDEMTRIFWKSIKDKLIFPFVELDIKYFDLGLTNRDATNDNVTIESAQATLRYNVAIKCATITPDEARVKEFKLKQMWKSPNGTIRNILNGTVFREPIICKNIPRLVPGWTKPICIGRHAFGDQYRATDIVIQESGKLKLVFVPNGHNEKKEFEVFNFTGAGGVALSMYNTDESIRAFAEASMNTAYQKKWPLYLSTKNTILKKYDGRFKDIFQEVYETQWKSKYEAAGIW

SEQ ID NO: 3157 - protein, 412 aa, Castanea mollissima
MAFEKIKVANPIVEMDGDEMTRVFWKSIKDKLIFPFLDLDIKYFDLGLPYRDATDDKVTIESAEATLKYNVAIKCATITPDEARVKEFGLKQMWKSPNGTIRNILNGTVFREPIICKNVPRLVPGWTKPICIGRHAFGDQYRATDTVIKGAGKLKLVFVPEGKDEKTELEVYNFTGAGGVAIAMYNTDESIRAFAEASMNTAYQKKWPLYLSTKNTILKKYDGRFKDIFQEVYEANWKSKYEAAGIWYEHRLIDDMVAYAVKSEGGYVWACKNYDGDVQSDFLAQGFGSLGLMTSVLVCPDGKTIEAEAAHGTVTRHFRVHQKGGETSTNSIASIFAWSRGLSHRAKLDDNAKLLDFTEKLEAACVGTVESGKMTKDLALLIHGSKVTREQYLSTEEFIDAVATELKARLSA

SEQ ID NO: 3158 - protein, 416 aa, Cichorium intybus
MAFNKIKVENPIVEMDGDEMTRIFWQSIKDKLIFPFLDLDIKYYDLGLPNRDATDDKVTVESAEATLKYNVAIKCATITPDEARMKEFTLKSMWKSPNGTIRNILNGTVFREPILCKNIPRLIPGWTKPICIGRHAFGDQYKATDAVIKGPGKLKLVFVPEGEGENIDLEVYKFTGAGGVALSMYNTDESIAAFAEASMNTAYQKKWPLYLSTKNTILKKYDGRFKDIFQEVYESNWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDNNSKLLDFTEKLEAACIGTVESGKMTKDLALILHGSKLSREHYLNTEEFIDAVANELKARLVGKSSL

SEQ ID NO: 3159 - protein, 413 aa, Cichorium intybus
MAFEKIKVANPIVEMDGDEMTRVFWESIKNKLIFPFLELDIKYYDLGLLNRDATDDKVTVESAEATLKYNVAIKCATITPDEARMKEFTLKSMWKSPNGTIRNILNGTVFREPILCKNIPRLIPGWTKPICIGRHAFGDQYKATDAVIKGPGKLKMVFVPEGQGESVDLEVYNFTGAGGVALSMYNTDESITSFAEASMNTAYLKKWPLYLSTKNTILKKYDGRFKDIFQEVYEKNWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNSRLLDFTEKLEAACIGTVESGKMTKDLALILHGSKLSREHYLNTEEFIDAVADELKTRLSAK

SEQ ID NO: 3160 - protein, 414 aa, Citrus sinensis
MAFQKIKVANPIVEMDGDEMTRVFWKSIKDKLIFPFLELDIKYFDLGLPNRDATDDKVTVESAEATLKYNVAIKCATITPDEARVKEFVLKQMWKSPNGTIRNILNGTVFREPIICKNVPRLIPGWTKPICIGRHAFGDQYRATDTVIQGPGKLKLVFVPEGKDEKTELEVYNFTGEGGVALSMYNTDESIRAFAEASMNTAYQKKWPLYLSTKNTILKKYDGRFKDIFQEVYEANWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDNNARLLDFTEKLEAACIGTVESGKMTKDLALIIHGSKMTREHYLNTEEFIDAVADDLRARLSGKA

SEQ ID NO: 3161 - protein, 416 aa, Citrus sinensis
MEFQKIKVANPIVEMDGDEMTRVIWKLIKDKLINPFLELDIKYFDLGLPNRDATDDQVTIQSAQATLKYNVAIKCATITPDEVRVKEFNLKRMWKSPNGTIRNILNGTVFREPIICKNIPRLVSGWTKPICIGRHAFGDQYRATDAVIQGPGKLKLVFVPDGLNQKTEWEVYSFTGAGGVALSMYNTDESVRSFAEASMNTAYQKKWPLYLSTKNTILKNYDGRFKDIFQEVYKAQWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSQGLAHRAKLDGNPRLLDFTEKLEAACIATVESGKMTKDLALLIHGPQVARPQYLNTEEFIDAVSETLKERMSIKAKL

SEQ ID NO: 3162 - protein, 416 aa, Coffea canephora
  misc_feature (353)..(353): Xaa can be any naturally occurring amino acid
MAFEKIKVANPIVEMDGDEMTRVIWKAIKDKLILPFLELDIKYFDLGLPHRDATDDKVTVESAEATLKYNVAIKCATITPDEARVKEFGLKAMWKSPNGTIRNILNGTVFREPILCKNVPRLVPGWNKPICIGRHAYGDQYRATDTVIKGAGKLKLVFVPEGADEKTELEVFNFTGAGGVALSMYNTDESIHAFADASMNVAYQKKWPLYLSTKNTILKKYDGRFKDIFQEVYEANWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNPXLLDFTEKLEAACIGTVESGKMTKDLALIIHGPKLSRERYLNTEEFIDAVADDLRARLSCKASL

SEQ ID NO: 3163 - protein, 411 aa, Gossypium hirsutum
MGFEKIKVANPIVEMDGDEMTRVIWKSIKDKLILPFVELDIKYFDLGLPHRDATDDKVTIESAEATLKYNVAIKCATITPDEARVKEFDLKQMWKSPNGTIRNILNGTVFREPIICKNVPRLVPGWTKPICIGRHAFGDQYRATDAVIKGAGKLKLVFVPEGQGEKTEYEVFNFTGEGGVSLAMYNTDESIRAFAEASMNTAYQKKWPLYLSTKNTILKKYDGRFKDIFQEVYEANWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNPKLLDFIEKLEAACIATVESGKMTKDLALIIHGSKLARDKYLNTEEFIDAVAADLKARLC

SEQ ID NO: 3164 - protein, 417 aa, Gossypium hirsutum
MAFPTKIKVMNPIVEMDGDEMTRIIWKSIKEKLIFPFLELDIKYFDLGLHNRDATNDEVTIASAEATLKYNVAIKCATITPDEGRVKEFNLKKMWKSPNGTIRNILNGTVFREPIICKNVPRLVPSWTKPICIGRHAFGDQYRATDLVVQESGKLMLVFVPDTSNEKKELEVFNFKGAGGVALSMYNTDESIRAFAEASMTTAYQKKWPLYLSTKNTILKSYDGRFKDIFHEVYETQWKSKFEAEGIWYEHRLIDDMVAYALKSEGGYVWACKNYDGDVQSDFLAQGFGSLGLMTSVLMCPDGKTIEAEAAHGTVTRHYRVHKTGGETSTNSIASIFAWSRGLAHRARLDGNDRLLDFTQKLEAACVGTVESGKMTKDLALLIHGPKVSRSQYLNTEEFIEAVAKELSNRMYVKPKL

SEQ ID NO: 3165 - protein, 412 aa, Vigna unguiculata
MAFQKITVANPIVEMDGDEMTRVIWKSIKDKLILPFLELDIKYYDLGLPYRDQTDDKVTIESAEATLKYNVAIKCATITPDEARVKEFGLKNMWKSPNGTIRNILNGTVFREPILCKNIPRLVPGWTKPICIGRHAFGDQYRATDTVIKGAGKLKLVFVPEGKGEKTELEVFDFTGQGGVSLAMYNTDESIRSFAEASMATALEKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEASCIGVVEAGKMTKDLALIIHGSKLSREHYLNTEEFIDAVAADLRKKLSA

SEQ ID NO: 3166 - protein, 232 aa, Cynara scolymus
MAFDKIKVTNPIVEMDGDEMTRIFWQSIKDKLIFPFVDLDIKYYDLGLPNRDATDDKVTIESAEATLKYNVAIKCATITPDEARMKEFTLKSMWKSPNGTIRNILNGTVFREPILCKNIPKLIPGWTKPICIGRHAFGDQYKATDAVIKGPGKLKMVFVPEGEGEKTELEVYNFTGAGGVALSMYNTDESIRAFAEASMNTAYEKKWPLYLSTKNTILKKYDGRFRTYFRSL

SEQ ID NO: 3167 - protein, 413 aa, Cynara scolymus
MAFEKIKVANPIVEMDGDEMTRVFWESIKNKLIFPFVDLDIKYYDLGLLNRDATDDKVTIESAEATLKYNVAIKCATITPDEARMKEFTLKSMWKSPNGTIRNILNGTVFREPILCKNIPRLIPGWTKPICIGRHAFGDQYKATDAVIKGPGKLKMVFVPEGQGENIDLEVYNFTGAGGVALSMYNTDESITSFAEASMNTAYLKKWPLYLSTKNTILKKYDGRFKDIFQEVYESNWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTEKLEAACIGCVESGKMTKDLALIIHGSKLSREHYLNTEEFIDAVADELKARLSAK

SEQ ID NO: 3168 - protein, 332 aa, Taraxacum officinale
MKEFTLKSMWKSPNGTIRNILNGTVFREPILCKNIPRLIPGWTKPICIGRHAFGDQYKATDAVIKGPGKLKLVFVPEGEGEKLDLEVYNFTGAGGVAQSMYNTDESITAFAEASMNTAYEKKWPLYLSTKNTILKKYDGRFKDIFQQVYESNWKSKFDAAGIWYEHRLIDDMVAYALKSDGGYVWACKNYDGDVQSDMLAQGFGSLGLMTSVLVCPDGKTIESEAAHGTVTRHYRVHQKGGETSTNSIASIFAWTRGLAHRAKLDNNSKLLDFTEKLEAACIGTVESGKMTKDLALIIHGSKLSREHYLNTEEFIDAVANELKARLVGKSSL

SEQ ID NO: 3169 - protein, 416 aa, Eucalyptus gunnii
MGFEKIKVENPIVEMDGDEMTRVFWKSIKDKLIFPFLELDIKYFDLGLPHRDATDDKVTIESAEATLKYNVAIKCATITPDEARMKEFTLKQMWKSPNGTIRNILNGTVFREPIMCKNIPRLVPGWSKPICIGRHAFGDQYKATDTVIKGAGKLKLVFVPEGTDEKTELEVYNFTGAGGVALSMYNTDESIRSFAEASMNTAYQKKWPLYLSTKNTILKKYDGRFKDIFQEVYEANWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDNNAKLLDFAEKLEAACIGTVESGKMTKDLALLIHGPKFTRDQYLNTEEFIDAVAAELKARLSCQSLL

SEQ ID NO: 3170 - protein, 412 aa, Festuca arundinacea
  misc_feature (357)..(357): Xaa can be any naturally occurring amino acid
MAFEKIKVANPIVEMDGDEMTRVFWQSIKDKLIFPFLDLDIKYYDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVALAMYNTDESIQGFAAASMAIAYEKKWPLYLSTKNTILKKYDGRFKDIFQAIYEADWKSKFEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLDFTXKLEEACVGTVESGKMTKDLALLVHGSSKVTRGDYLNTEEFIDAVAAELQSRLAAN

SEQ ID NO: 3171 - protein, 412 aa, Festuca arundinacea
MAFEKIKVANPIVEMDGDEMTRVFWQSIKDKLIFPFLDLDIKYYDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVALAMYNTDESIQGFAAASMAIAYEKKWPLYLSTKNTILKKYDGRFKDIFQAIYEADWKSKFEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLDFTQKLEDACVGTVESGKMTKDLALLVHGSSKVTRGDYLNTEEFIDAVAAELQSRLAAN

SEQ ID NO: 3172 - protein, 410 aa, Zingiber officinale
MAYEKIKVANPIVEMDGDEMTRVFWNSIKEKLIFPFLDLDIKYFDLGLPHRDATDDKVTIESAEATLKYNVAIKCATITPDEARVKEFNLKSMWKSPNGTIRNILNGTVFREPIICKNIPRLVPGWTKPICIGRHAFGDQYRATDTVIKGPGKLKLIFEGKEEEVELEVYNFTGAGGVALSMYNTDESIRSFAEASMATALQKKWPLYLSTKNTILKKYDGRFKDIFQEVYETEWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDDNARLLDFTEKLEAACVGTVESGKMTKDLALLIHGSRVTREKYLNTEEFIDAVASELRAKLSS

SEQ ID NO: 3173 - protein, 412 aa, Vitis vinifera
MAFDKIKVANPIVEMDGDEMTRVFWKSIKDKLIFPFLELDIKYFDLGLPHRDATDDKVTVESAEATLKYNVAIKCATITPDEGRMKEFDLKQMWKSPNGTIRNILNGTVFREPIICKNIPRLVPSWTKPICIGRHAFGDQYRATDTVIKGAGKLKLVFVPEGKDEKTELEVFNFTGAGGVALSMYNTDESIYAFAEASMNTAYLKQWPLYLSTKNTILKKYDGRFKDIFQEVYETQWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWSRGLAHRAKLDDNARLLDFTEKLEAACVGTVESGKMTKDLALLIHGSKVTRDWYLNTEEFIDAVAAELTAKLSC

SEQ ID NO: 3174 - protein, 414 aa, Actinidia deliciosa
  misc_feature (2)..(2): Xaa can be any naturally occurring amino acid
MXFEKIKVANPIVEMDGDEMTRVFWKSIKEKLIFPFLELDIKYFDLGLPHRDATDDKVTIESAEATLKYNVAIKCATITPDEARVEEFKLKQMWKSPNGTIRNILNGTVFREPIICKNVPRLIPGWTKPICIGRHAFGDQYRATDAVIKGPGKLKLVFVPEGKDEKTELEVYNFTGAGGVALSMYNTDESIYAFAEASMNTAYQKKWPLYLSTKNTILKKYDGRFKDIFQEVYETSWKSKYEAAGIWYEHRLIDDMVAYALKSDGGYVWACKNYDGDVQSDFLAQGFGSLGLMTSILVCPDGKTIEAEAAHGTVTRHYRVHQKGGETSTNSIASIFAWSRGLAHRAKLDNNARLLDFTEKLEAACVGTVESGKMTKDLALINHGPKLSRDLYLNTEEFIDAVANELRGRLGCKA

SEQ ID NO: 3175 - protein, 414 aa, Actinidia deliciosa
MAFEKIKVVNPIVEMDGDEMTRIFWKSIKEKLIFPFLELDIKYFDLGLPHRDATDDKVTVESAEATLKYNVAIKCATITPDEGRVEEFKLKQMWKSPNGTIRNILNGTVFREPIICKNVPRLIPGWTKPICIGRHAFGDQYRATDAVIKGPGKLKLVFVPEGKDEKTELEVYNFTGAGGVALSMYNTDESIYAFAEASMNTAYQKKWPLYLSTKNTILKKYDGRFKDIFQEVYETSWKSKYEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDDNARLLDFTEKLEAACVGTVESGKMTKDLALISHGSKLSRDLYLNTEEFIDAVANELRGRLGCKA

SEQ ID NO: 3176 - protein, 416 aa, Actinidia deliciosa
  misc_feature (193)..(193): Xaa can be any naturally occurring amino acid
MAFEKIKVANPIVEMDGDEMTRVFWKSIKDKLIFPFLELDIKYFDLGLPYRDATDDKVTIESAEATLKYNVAIKCATITPDEARVKEFNLKQMWKSPNGTIRNILNGTVFREPIICKNVPRLIPGWTKPICIGRHAFGDQYRATDAVIQGPGKLKLVFVPEGKDEKTELEVYNFTGAGGVALSMYNTDESIYXFAEASMTTAYQKKWPLYLSTKNTILKKYDGRFKDIFQDVYETKWKSKYEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDNNARLLDFTEKLEAACIGAVESGKMTKDLALIIHGSKLTRGQYLNTEEFIDAVADELRARFSFKTKL

SEQ ID NO: 3177 - protein, 412 aa, Lactuca sativa
MAFEKIKVANPIVEMDGDEMTRIFWESIKNKLIFPFLDLDIKYYDLGLLNRDATDDKVTVESAEATLKYNVAIKCATITPDEARMQEFTLKSMWKSPNGTIRNILNGTVFREPILCKNIPRLIPGWTKPICIGRHAFGDQYKATDAVIKGPGKLKMVFVPEGQGETIDLEVYNFTGAGGVALSMYNTDESITSFAEASMNTAYLKKWPLYLSTKNTILKKYDGRFKDIFQAVYESNWKSKFEAAGIWYEHRLIDDMVAYALKSDGGYVWACKNYDGDVQSDMLAQGFGSLGLMTSVLVCPDGKTIESEAAHGTVTRHYRVHQKGGETSTNSIASIFAWTRGLAHRAKLDDNSKLLDFTEKLEAACIGCVESGKMTKDLALIIHGSKLSREHYLNTEEFIDAVALELKTRLSA

SEQ ID NO: 3178 - protein, 409 aa, Leymus cinereus x Leymus triticoides
  misc_feature (180)..(180): Xaa can be any naturally occurring amino acid
  misc_feature (390)..(390): Xaa can be any naturally occurring amino acid
MAFEKIKVANPIVEMDGDEMTRVFWQSIKDKLIFPFLDLDIKYFDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVAXAMYNTDESIRGFAAASMAIAYEKKWPLYLSTKNTILKKYDGRFKDIFQEIYEADWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDDNARLLEFAQKLEDACVGTVESGKMTKDLALLVHGSSKVTRSXYLNTEEFIDAVAAELKSRL

SEQ ID NO: 3179 - protein, 414 aa, Liriodendron tulipifera
  misc_feature (391)..(391): Xaa can be any naturally occurring amino acid
  misc_feature (393)..(393): Xaa can be any naturally occurring amino acid
  misc_feature (404)..(404): Xaa can be any naturally occurring amino acid
  misc_feature (414)..(414): Xaa can be any naturally occurring amino acid
MAFEKIKVTNPIVEMDGDEMTRVFWKSIKDKLIFPFLELDIKYFDLGLPHRDASDDKVTVESAEATLKYNVAIKCATITPDEARMTEFNLKSMWKSPNGTIRNILNGTVFREPIICKNVPRLIPGWNKPICIGRHAFGDQYKATDTVIKGPGKLKLVFEGKEEEIELEVYNFTGAGGVALSMYNTDESIYAFAEASMNTAYEKKWPLYLSTKNTILKKYDGRFKDIFQEVYESKWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDNNARLLDFTEKLEAACVGTVESGKMTKDLALIIHGSKITRDKYXNXEEFIDAVAEEXKVRLSSTSKX

SEQ ID NO: 3180 - protein, 412 aa, Lotus japonicus
MAFDKIKVANPIVEMDGDEMTRVIWKSIKDKLILPFLELDIKYFDLGLPYRDETDDKVTVESAEATLKYNVAIKCATITPDEARVKEFGLKQMWRSPNGTIRNILNGTVFREPILCKNVPRLVPGWTKAICIGRHAFGDQYRATDQVIKGAGKLKLVFVPEGQGEETELEVYNFTGKGGVALAMYNTDESIRSFAEASMATAYEKKWPLYLSTKNTILKKYDGRFKDIFQEVYEAGWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLSDFTDKLEAACIGVVESGKMTKDLALILHGSKLSREHYLNTEEFIDAVAAELKAKLSA

SEQ ID NO: 3181 - protein, 416 aa, Lotus japonicus
MEFRKIKVDNPIVEMDGDEMTRVIWKLIKDKLIFPFLELDIKYFDLGLPHRDATNDRVTIESAEATLKYNVAIKCATITPDEARVKEFNLKQMWKSPNGTIRNILNGTVFREPIICKNVPRLVSGWTKPICIGRHAFGDQYRATDTIIRGPGKLKLVFEPSGHEEIKDLEVYNFDGAGGVALSMYNTDESIQAFAEASMNIAYQKKWPLYLSTKNTILKKYDGRFKDIFQEVFDTQWSQKFKAAGIWYEHRLIDDMVAYSLKSDGGYVWACKNYDGDVQSDFIAQGFGSLGLMSSILVCPDGKTIESEAAHGTVTRHYRVHQKGGETSTNSIASIFAWSRGLAHRAKLDGNARLSDFTEKLETACIGTVELGKMTKDLALLVHGPKVYRSQYFNTEEFIDAVADQLRTRLSTQAKL

SEQ ID NO: 3182 - protein, 414 aa, Eragrostis curvula
  misc_feature (204)..(204): Xaa can be any naturally occurring amino acid
  misc_feature (406)..(406): Xaa can be any naturally occurring amino acid
  misc_feature (413)..(413): Xaa can be any naturally occurring amino acid
MAFDKIKVANPIVEMDGDEMTRVFWKSIKDKLIFPFVELDIKYYDLGILHRDATDDKVTVEAAEATLKYNVAIKCATITPDETRVKEFNLKQMWRSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTMAYEKXWPLYLSTKNTILKKYDGRFKDIFQEVYEADWKSKYEAAGIWYEHRLIDDMVAYALKSEGAYVWACKNYDGDVQSDFLAQGFGSLGLMTSVLVCPDGKTIEAEAAHGTVTRHFRVHQKGGETSTNSIASIFAWTRGLAHRAKLDDNARLLDFAQKLEAACIGTVESGKMTKDLALLVHGSSKVTRGDYLNTEEFIDAVAAELXSRLSANXA

SEQ ID NO: 3183 - protein, 415 aa, Zea mays
MAFNKIKVSNPVVEMDGDEMTRVFWKSIKDKLIFPFVDLDIKYFDLGLPHRDATDDKVTVEAAEATLKYNVAIKCATITPDEARVNEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFADASMATAYEKKWPLYLSTKNTILKKYDGRFKDIFQEVYEAGWKTKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACVGAVESGKMTKDLALLVHGSSNITRSHYLNTEEFIDAVADELRSRLAANSNL

SEQ ID NO: 3184 - protein, 412 aa, Zea mays
MAFEKIKVSNPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAAASMTTAYEKKWPLYLSTKNTILKKYDGRFKDIFQEVYEADWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGAVESGKMTKDLALLVHGSSKVTRSHYLNTEEFIDAVATELRSRLGAN

SEQ ID NO: 3185 - protein, 412 aa, Zea mays
MAFEKIKVSNPIVEMDGDEMTRVFWQSIKDKLILPFLDLDIKYYDLGILHREATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTTAYEKKWPLYLSTKNTILKKYDGRFKDIFQEVYEADWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVETVESGKMTKDLAILVHGSSSVTRSHYLNTEEFIDAVATELRSRLGAN

SEQ ID NO: 3186 - protein, 412 aa, Medicago truncatula
MGFQKIKVANPIVEMDGDEMTRIIWKYIKDKLILPFVELDIKYFDLGLPYRDETDDKVTVESAEATLKYNVAIKCATITPDEARVKEFGLKSMWRSPNGTIRNILNGTVFREPIICKNIPRLIPGWTKPICIGRHAFGDQYRATDSVIKGPGKLKLVFVPEGQGETTDLEVYNFTGEGGVALAMYNTDESIRSFAEASMAVALEKKWPLYLSTKNTILKKYDGRFKDIFQEVYEAGWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNATLLDFTEKLEAACIGVVESGKMTKDLALILHGSKLSREHYLNTEEFIDAVAADLKTKISA

SEQ ID NO: 3187 - protein, 416 aa, Medicago truncatula
MGFQKIRVDNPIVEMDGDEMTRVIWRMIKDKLIFPFLELDIKYFDLGLPHRDATNDRVTVESGEATLKYNVAIKCATITPDEGRVKEFNLKQMWKSPNGTIRNILNGTVFREPIICKNIPRLVSGWTKPICIGRHAFGDQYRATDAVIKGPGKLKLVFAPSGHEEPKELEVYNFTGAGGVGLAMYNTDESIRAFAEASMNIALEKKWPLYLSTKNTILKKYDGRFKDIFQEVYDSKWSHKFKAAGIWYEHRLIDDMVAYALKSDGGYVWACKNYDGDVQSDFIAQGFGSLGLMTSTLVCPDGKTIEAEAAHGTVTRHFRVHQKGGETSTNSIASIFAWSQGLAHRAKLDGNARLLDFTEKLEAACIGTVELGKMTKDLALLIHGPKVSRSHYLNTEEFIDAVAEELRTRLTTQAKL

SEQ ID NO: 3188 - protein, 412 aa, Pennisetum glaucum
MAFEKIKVANPIVEMDGDEMTRVFWQSIKDKLIFPFLDLDIKYYDLGILHREATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTTAYEKKWPLYLSTKNTILKKYDGRFKDIFQEVYEAAWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACIGTVESGKMTKDLALLVHGSANVTRSHYLNTEEFIDAVAAELQSRLAAN

SEQ ID NO: 3189 - protein, 407 aa, Pennisetum glaucum
ANPIVEMDGDEMTRIFWKSIKDKLIFPFLDLDIKYFDLGLPHRDATDDKVTVEAAEATLKYNVAIKCATITPDEARVEEFSLKAMWKSPNGTIRNILNGTVFREPIICKNIPRLVPGWTKPICIGRHAFGDQYRATDAVIKGPGKLKLVYEGKEEQIELEVFNFTGAGGVALAMYNTDESIHAFAEASMATAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAANSNL

SEQ ID NO: 3190 - protein, 412 aa, Mimulus guttatus
MAFEKIKVANPIVEMDGDEMTRVIWTFIKEKLIFPFVELDIKYYDLGLPHRDATDDKVTVESAEATLKYNVAIKCATITPDEARMTEFNLKNMWKSPNGTIRNILNGTVFREPILCKNVPRLVPGWTKPICIGRHAFGDQYKATDAVIKGPGKLKMVFVPEGNGETTDLEVYNFTGAGGVALSMYNTDESINAFADASMNTAYEKKWPLYLSTKNTILKKYDGRFKDIFQEVYEAKWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLEFTEKLEAACIGVVESGKMTKDLALIIHGSRLTREHYLNTEEFIDAVAVELKAGLSC

SEQ ID NO: 3191 - protein, 415 aa, Nicotiana benthamiana
  misc_feature (342)..(342): Xaa can be any naturally occurring amino acid
  misc_feature (358)..(358): Xaa can be any naturally occurring amino acid
MAFQKIKVVNPIVEMDGDEMTRVIWKLIKDKLIFPFVELDIKYFDLGLPHRDATDDKVTVESAEATLKYNVAIKCATITPDEGRMKEFNLKRMWKSPNGTIRNILNGTVFREPILCKNVPRLVPGWSKPICIGRHAFGDQYRATDTVIQGPGKLKLVFVPEGKDEKIEFEVYNFTGAGGVALSMYNTDESIRSFAEASMNMAYQKKWPLYLSTKNTILKKYDGRFKDIFQEVYESNWKLKFEEAGIWYEHRLIDDMVAYALKSDGGYVWACKNYDGDVQSDFLAQGFGSLGLMTSILICPDGKTIESEAAHGTVTRHYRVHQKGGETSTNSIASIFAWTRGXAHRAKLDNNAALLDFXKKLEAACIGAVENGKMTKDLALIVHGSKVARHQYANTEEFIDAVADELKARLLKAKI

SEQ ID NO: 3192 - protein, 416 aa, Elaeis guineensis
MALGKIKVANPIVEMDGDEMTRVIWKSIKDKLIFPFLDLNIKYFDLGLPNRDATNDKVTVESAEATLKYNVAIKCATITPDETRMKEFNLKSMWRSPNGTIRNILNGTVFREPIICKNVPRLVPGWTKPICIGRHAFGDQYRATDTVIKGPGKLKLVFEGKEEQAELEVFNFTGAGGVALSMYNTDESIRAFGEASMNMAYQKRWPLYLSTKNTILKKYDGRFKDIFQEVYETGWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWSRGLAHRAKLDNNGQLLDFTEKLEASCIGTVESGKMTKDLALLIYGSKVTRDQYLNTEEFIDAVAEELRARLSRKSKLSD

SEQ ID NO: 3193 - protein, 411 aa, Arachis hypogaea
MGFEKIKVDNPIVEMDGDEMTRVIWKSIKDKLILPFMELDIKYFDLGLPYRDQTDDKVTVESAEATLKYNVAIKCATITPDEARVKEFDLKQMWKSPNGTIRNILNGTVFREPILCKNVPRLVPGWTKPICIGRHAFGDQYRATDTVIKGAGKLKLVFVPESGEKTELEVFNFTGEGGVSMAMYNTDESIRAFAESSMATALEKKWPLYLSTKNTILKKYDGRFKDIFQEVYEKNWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDNNARLLDFTQKLEAACIGVVEAGKMTKDLALIIHGPKLSRENYLNTEEFIDAVAAELKAQLSA

SEQ ID NO: 3194 - protein, 412 aa, Pisum sativum
MAFQKIKVASPIVEMDGDEMTRVIWKSIKDKLIFPFLELDIKYFDLGLPHRDQTDDKVTVESAEATLKYNVAIKCATITPDEARVEEFGLKSMWRSPNGTIRNILNGTVFREPIICKNVPRLIPGWTKPICIGRHAFGDQYRATDAVIKGPGKLKMVFVPEGKGETTDLEVYNFTGEGGVALAMYNTDESIRSFAEASMATALEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLEFTEKLEAACIGAVESGKMTKDLALILHGSQLKREHYLNTEEFIDAVAAELKSKISA

SEQ ID NO: 3195 - protein, 415 aa, Capsicum annuum
MAFQKINVQNPIVEMDGDEMTRVIWKSIKDKLILPFLELDIKYFDLGLPHRDLTDDKVTVESAEATLKYNVAIKCATITPDEARVKEFKLKSMWRSPNGTIRNILNGTVFREPIMCKNIPRLVPGWTKPICIGRHAFGDQYRATDAVIQGAGKLKLVFVPEGSDEKTEYEVYNFTGAGGVALSMYNTDESIRAFADASMNMAYQKKWPLYLSTKNTILKKYDGRFKDIFQEVYEASWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDKNERLLDFTEKLEAACIGAVESGKMTKDLALIIHGSKLSREHYLNTEEFIDAVADELKAKLLKAKA

SEQ ID NO: 3196 - protein, 415 aa, Capsicum annuum
MAFQKIKVANPIVEMDGDEMTRVIWKLIKDKLILPFVELDIKYFDLGLPHRDATDDKVTIESAKATLKYNVAIKCATITPDEARMKEFNLKHMWKSPNGTIRNILNGTVFREPILCKNIPRLVPGWSKPICIGRHAFGDQYRATDTVIQGAGKLKLVFVPEGTDQKTEFEVYNFTGAGGVALSMYNTDESIRSFAEASMNMAYQKKWPLYLSTKNTILKKYDGRFKDIFQEVYESNWKLKFEEAGIWYEHRLIDDMVAYALKSDGGYVWACKNYDGDVQSDFLAQGFGSLGLMTSILICPDGKTVEAEAAHGTVTRHYRVHQKGGETSTNSIASIFAWTRGLAHRAMLDNNAALLDFTNKLEAACIGAVENGKMTKDLALIIHGSKVARHQYVNTEDFIDAVADELKARLLKPKI

SEQ ID NO: 3197 - protein, 415 aa, Petunia hybrida
MAFEKIKVENPIVEMDGDEMTRVIWKSIKDKLILPFLELDIKYFDLGLPHRDATDDKVTVESAEATQKYNVAIKCATITPDEARVKEFNLKSMWRSPNGTIRNILNGTVFREPIMCKNIPRLVPGWTKPICIGRHAFGDQYRATDTVIKGAGKLKLVFVPEGTDDKTEFEVYNFTGAGGVALSMYNTDESVRSFAEASMNMAYIKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDSNERLSDFTEKLEAACIGAVESGKMTKDLALIIHGSKLSREHYLNTEEFIDAVADELKARLLKAKA

SEQ ID NO: 3198 - protein, 411 aa, Physcomitrella patens
MAFAKIHVANPIVEMDGDEMTRIIWKMIKDKLIFPFLDLDLKYFDLGIEHRDATDDRVTIESAEATKKYNVAVKCATITPDEARVKEYNLKSMWRSPNGTIRNILNGTVFREPILCKNIPKLVPGWTSPICIGRHAFGDQYKATDAVFKGPGKLKMVFVPENGGETQDLTVYDFEGAGGVALTMYNTDESIRSFAESSMAMAYEKKWPLYLSTKNTILKKYDGRFKDIFQEVYEQEGWKAKFDAAGIWYEHRLIDDMVAYALKSEGGYVWACKNYDGDVQSDMLAQGFGSLGLMTSVLVCPDGKTIEAEAAHGTVTRHYRVHQKGGETSTNSIASIFAWTRGLSHRGKLDGNEKLVDFATKLEQACVGTVENGKMTKDLALLIHGSKLSRDTYLNTEEFIDAVAEELKSKL

SEQ ID NO: 3199 - protein, 417 aa, Pinus taeda
MASEKIKVENPIVEMDGDEMTRVIWTMIKDKLIFPFVELDIKYFDLGLPHRDATDDKVTIESAEATLKYNVAIKCATITPDEARVKEFDLKAMWKSPNGTIRNILNGTVFREPILCKNVPKLVPGWTKAICIGRHAFGDQYKATDTVIKGPGKLKLVFVPEKDGETSELEVYNFKGDGGVALAMYNTDESIRSFAEASMTVAYEKKWPLYLSTKNTILKKYDGRFKDIFQEVYESNWKSKYEKAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDGNARLLEFAEKLEVACVGTVEAGKMTKDLALIIHGSNLSREHYLNTEEFIDAVAEDLKIRLSAKPKSS

SEQ ID NO: 3200 - protein, 417 aa, Pinus taeda
MASEKIKVENPIVEMDGDEMTRVIWTMIKDKLIFPFVELDIKYFDLGLPHRDATDDKVTIESAEATLKYNVAIKCATITPDEARVKEFDLKAMWKSPNGTIRNILNGTVFREPILCKNVPKLVPGWTKAICIGRHAFGDQYKATDTVIKGPGKLKLVFVPEKDGETSELEVYNFKGDGGVALAMYNTDESIRSFAEASMTVAYEKKWPLYLSTKNTILKKYDGRFKDIFQEVYESNWKSKYEKAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDGNARLLEFAEKLEVACVGTVEAGKMTKDLALIIHGSNLSREHYLNTEEFIDAVAADLKIRLSAKPKSS

SEQ ID NO: 3201 - protein, 414 aa, Populus trichocarpa
MAFEKIKVANPIVEMDGDEMTRVFWQSIKEKLIFPFLELDIKYFDLGLPHRDATDDKVTIESAEATLKYNVAIKCATITPDEDRVKEFKLKQMWKSPNGTIRNILNGTVFREPIICKNIPRLVPGWTKAICIGRHAFGDQYRATDAVIKGAGKLKLVFVPEGQDEKTELEVYNFTGAGGVALAMYNTDESIRSFAEASMNTAYQKKWPLYLSTKNTILKKYDGRFKDIFQEVYEANWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDDNAKLLDFTEKLEAACVGAVESGKMTKDLALLIHGSKVSRDQYLNTEEFIDAVAEELKARLSVEA

SEQ ID NO: 3202 - protein, 416 aa, Populus trichocarpa
MAFDKIKVTNPIVEMDGDEMTRVIWKSIKDKLIFPFLDLDIKYFDLGLPNRDATDDRVTIESAEATLKYNVAIKCATITPDEGRVKEFNLKNMWKSPNGTIRNILNGTVFREPIICKNIPRLVSGWTMPICIGRHAFGDQYRATDTVIQGPGKLKLVFVPDGQSEKTEFEVFKFKGAGGVALSMYNTDESIHAFAEASMNTAYLKKWPLYLSTKNTILKKYDGRFKDIFQEVYEMQWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDGNVRLSDFTAKLEASCIGAVESGKMTKDLALLIHGPRVSRGRYLNTEEFIDAVAEELKARLLVRAKL

SEQ ID NO: 3203 - protein, 416 aa, Populus trichocarpa
MAFDKIKVTNPIVEMDGDEMTRVIWKSIKDKLIFPFLDLDIKYFDLGLPNRDATDDRVTVESAEATLKYNVAIKCATITPDEGRVKEFNLKNMWKSPNGTIRNILNGTVFREPIICKNIPRLVSGWTKPICIGRHAFGDQYRATDTVIQGPGKLKLVFVPDGHNEKTEFEVFKFKGAGGVALSMYNTDESIQAFAEASMNTAYLKKWPLYLSTKNTILKKYDGRFKDIFQEVYETQWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSSGLAHRAKLDGNVKLMDFTAKLEASCIGAVESGKMTKDLALLIHGPRVSRSQFLNTEEFIDAVAEELRARLSVKAKL

SEQ ID NO: 3204 - protein, 414 aa, Populus trichocarpa
MAFEKIKVANPIVEMDGDEMTRIFWQSIKDKLIFPFVELDIKYFDLGLPHRDATDDKVTVESAEAALKYNVAIKCATITPDEARVKEFNLKQMWKSPNGTIRNILNGTVFREPIICKNIPRLVPGWTKPICIGRHAFGDQYRATDAVIKGAGKLKLVFVPEGQDEKTELEVYNFTGAGGVALAMYNTDESIRAFAEASMNTAYQKKWPLYLSTKNTILKKYDGRFKDIFQEVYEANWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWSRGLAHRAKLDDNARLLDFTEKLEAACIGAVESGKMTKDLALLIHGSKVSRDHYLNTEEFIDAVAEELKARLSIKA

SEQ ID NO: 3205 - protein, 415 aa, Solanum tuberosum
MAFQKITVQNPIVEMDGDEMTRVIWKSIKDKLILPFLELDIKYFDLGLPHRDATDDKVTVESAEATQKYNVAIKCATITPDEARVKEFNLKSMWRSPNGTIRNILNGTVFREPIMCKNIPRLVPGWTKPICIGRHAFGDQYRATDTVIKGAGKLKLVFVPEGSDEKTEFEVYNFTGAGGVALSMYNTDESVRSFAEASMNMAFQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSREHYLNTEEFIDAVADELKARLLKAKA

SEQ ID NO: 3206 - protein, 411 aa, Prunus persica
MAFQKIKVANPIVEMDGDEMTRVFWKSIKDKLILPFLELDIKYFDLGLPHRDATDDKVTVESAEATLKYNVAIKCATITPDEGRVKEFNLKSMWRSPNGTIRNILNGTVFREPILCKNIPRLIPGWTKPICIGRHAFGDQYRATDAVIKGPGKLKLVFVPDGKDEKTELEVYNFTGEGGVALAMYNTDESIRAFAEASMTTAYEKKWPLYLSTKNTILKKYDGRFKDIFQEVYEAKWKSQYEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTQKLEEACIGTVESGKMTKDLALIIHGPKLARNHYLNTEEFIEAVAEELRARLS

SEQ ID NO: 3207 - protein, 415 aa, Raphanus sativus
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPILCKNVPKLVPGWTKPICIGRHAFGDQYRATDAVIKGPGRLTMTFEGKDGKTETEVFTFTGEGGVAMAMYNTDESIRAFADASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKRRLFYGVSKI

SEQ ID NO: 3208 - protein, 410 aa, Raphanus sativus
MAFEKIKVANPIVEMDGDEMTRVIWKSIKDKLITPFVELDIKYFDLGLPHRDATDDKVTIESAEATKKYNVAIKCATITPDEGRVTEFGLKQMWRSPNGTIRNILNGTVFREPILCKNVPKLVPGWTKPICIGRHAFGDQYRATDAVIKGPGRLTMTFEGKDGKTETEVFTFTGEGGVAMAMYNTDESIRAFADASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNSKLLEFTEKLEAACVGTVESGKMTKDLALIIHGSKLSRDTYLNTEEFIDAVADELKTRLGA

SEQ ID NO: 3209 - protein, 414 aa, Oryza sativa
MAFEKIVVANPVVEMDGDEMTRVIWKWIKDKLIFPFLDLDIKYYDLGLPNRDATGDKVTIESAEATLKYNVAIKCATITPDEGRVKEFNLSAMWKSPNGTIRNILNGTVFREPIICKNIPRLVPGWIKPICIGRHAFGDQYRATDTVIKGPGKLKLVFDGREEQIELDVFNFTGAGGVALSMYNTDESIWAFAEASMNMAYQKRWPLYLSTKNTILKKYDGRFKDIFQENYETKWRAKFDDAGIWYEHRLIDDMVAYALKSEGGYVWACKNYDGDVQSDLIAQGFGSLGLMTSVLVCPDGRTIEAEAAHGTVTRHYRVHQKGGETSTNSIASIFAWTTGLGHRAKLDDNKRLLDFVQKLEAACVGTVESGKMTKDLALLVHGPNVSRDKYLNTVEFIDAVAEDLRTRLSVTSKL

SEQ ID NO: 3210 - protein, 412 aa, Oryza sativa
MAFEKIKVANPIVEMDGDEMTRIFWQSIKDKLIFPFLDLDIKYYDLGVLHRDATDDKVTVEAAEATLKYNVAIKCATITPDEARVKEFNLKQMWKSPNGTIRNIINGTVFREPIICKNVPRLVPGWTKPICIGRHAFGDQYRATDAVLKGPGKLKLVFEGKDEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLIHGSSNVTRSHYLNTEEFIDAVAAELRSRLAAN

SEQ ID NO: 3211 - protein, 207 aa, Secale cereale
  misc_feature (192)..(193): Xaa can be any naturally occurring amino acid
IVEMDGDEMTRVFWQSIKDKLIFPFLDLDIKYFDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVALAMYNTDESIRGFAEASMAIAYEXXWPLYLSTKTQSLRI

SEQ ID NO: 3212 - protein, 416 aa, Carthamus tinctorius
MAFDKIKVTNPIVEMDGDEMTRVFWQSIKDKLIFPFVELDIKYYDLGLPNRDATDDKVTIESAEATLKYNVAIKCATITPDEARMKEFTLKSMWKSPNGTIRNILNGTVFREPILCKNIPKLVPGWTKPICIGRHAFGDQYKATDAVIKGPGKLKMVFVPEGEGETTELEVYNFTGAGGVALSMYNTDESIRAFAEASMNTAYEKKWPLYLSTKNTILKKYDGRFKDIFQEVYESNWKSKFEAAGIWYEHRLIDDMVAYALKSDGGYVWACKNYDGDVQSDMLAQGFGSLGLMTSVLVCPDGKTIEAEAAHGTVTRHYRVHQKGGETSTNSIASIFAWTRGLAHRAKLDNNSKLLEFTEKLEAACIGTVESGKMTKDLALIIHGSKLSREHYLNTEEFIDAVANELKARLIGKSSL

SEQ ID NO: 3213 - protein, 413 aa, Carthamus tinctorius
MAFQKIKVANPIVEMDGDEMTRVFWESIKNKLIFPFLDLDIKYYDLGLLNRDATDDKVTVESAEATLKYNVAIKCATITPDEARMKEFTLKSMWKSPNGTIRNILNGTVFREPILCKNIPRLIPGWTKPICIGRHAFGDQYKATDAVIKGPGKLKMVFVPEGQGENIDLEVYNFTGAGGVALSMYNTDESITSFAEASMNTAYLKKWPLYLSTKNTILKKYDGRFKDIFQEVYESNWKSKFEAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWTRGLAHRAKLDDNAKLLDFTEKLEAACIGCVESGKMTKDLALILHGSKLSREHYLNTEEFIDAVADDLKARLSAN

SEQ ID NO: 3214 - protein, 415 aa, Solanum phureja
MAFQKIKVANPIVEMDGDEMTRVIWKLIKDKLILPFLELDIKYFDLGLPHRDATDDKVTIESAEATLKYNVAIKCATITPDEARMEEFNLKHMWKSPNGTIRNILNGTVFREPILCKNIPRLVPGWSKPICIGRHAFGDQYRATDTVIQGAGKLKLVFVPEGTDEKTEFEVYNFTGAGGVALSMYNTDESICSFAEASMNMAYQKKWPLYLSTKNTILKKYDGRFKDIFQEVYESKWKSKFEEAGIWYEHRLIDDMVAYALKSDGGYVWACKNYDGDVQSDFLAQGFGSLGLMTSILICPDGKTVEAEAAHGTVTRHYRVHQKGGETSTNSIASIFAWTRGLAHRAKLDNNAALLDFTKKLEAACIGAVENGKMTKDLALIIHGSKVARRQYVNTEEFIDAVADELKARLLKAKI

SEQ ID NO: 3215 - protein, 415 aa, Solanum phureja
MAFQKITVQNPIVEMDGDEMTRVIWKSIKDKLILPFLELDIKYFDLGLPHRDATDDKVTVESAEATQKYNVAIKCATITPDEARVTEFNLKSMWRSPNGTIRNILNGTVFREPIMCKNIPRLVPGWTKPICIGRHAFGDQYRATDTVIKGAGKLKLVFVPEGSDEKTEFEVYNFTGAGGVALSMYNTDESVRSFAEASMNMAFQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSREHYLNTEEFIDAVADELKARLLKAKA

SEQ ID NO: 3216 - protein, 412 aa, Sorghum bicolor
MAFEKIKVSNPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSASVTRSHYLNTEEFIDAVATELRSRLGAN

SEQ ID NO: 3217 - protein, 415 aa, Sorghum bicolor
MAFNKIQVANPVVEMDGDEMTRVFWKSIKDKLIFPFVDLDIKYFDLGLPYRDETDDKVTVEAAEATLKYNVAIKCATITPDEARVKEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFAEASMATAYEKKWPLYLSTKNTILKKYDGRFKDIFQEVYEAGWKTKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSANVTRSHYLNTEEFIDAVADELRSRLAANSNL

SEQ ID NO: 3218 - protein, 413 aa, Glycine max
MAAFQKIKVVNPIVEMDGDEMTRVIWKSIKDKLILPFLELDIKYYDLGLPYRDETDDKVTIESAEATLKYNVAIKCATITPDEARVKEFGLKSMWKSPNGTIRNILNGTVFREPILCKNIPRLVPGWTKAICIGRHAFGDQYRATDTVIKGAGKLKLVFVPEGQGEETEFEVFNFTGEGGVSLAMYNTDESIRSFAEASMATALEKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEAACIGVVEAGKMTKDLALILHGSKLSREHYLNTEEFIDAVAAELSAKLST

SEQ ID NO: 3219 - protein, 416 aa, Glycine max
MGFQKIRVGNPIVEMDGDEMTRVIWKLIKDKLIFPYLELDIKYFDLGLPHRDATNDRVTIESAEATLKYNVAIKCATITPDEARVKEFNLKQMWRSPNGTIRNILNGTVFREPIICKNIPRLVSGWTKPICIGRHAFGDQYRATDTVIKGPGKLKLVFAPSGNEGIKELEVYNFTGAGGIALSMYNTDESIRAFAEASMNFAYQKKWPLYLSTKNTILKKYDGRFKDIFQEVFDTQWNHKFKAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDGNARLLDFTEKLEAACIGTVELGKMTKDLALLVHGPKVSRSQYLNTEEFIDAVAEELRTRLSSQSKL

SEQ ID NO: 3220 - protein, 416 aa, Glycine max
MGFQKIRVGNPIVEMDGDEMTRVIWKLIKDKLIFPYLELDIKYFDLGLPHRDATNDRVTIESAEATLKYNVAIKCATITPDEARIKEFNLKQMWRSPNGTIRNILNGTVFREPIICKNIPRLVSGWTKPICIGRHAFGDQYRATDTVIKGPGKLKLVFAPSGNEGIKELEVYNFTGDGGIALSMYNTDESIRAFAEASMNFAYQKKWPLYLSTKNTILKKYDGRFKDIFQEVFDTQWSHKFKAAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDGNARLLDFTEKLEAACIGTVELGKMTKDLALLVHGPKVSRYQYLNTEEFIDAVAKELQTRLSSQSKL

SEQ ID NO: 3221 - protein, 413 aa, Glycine max
MAAFQKIKVANPIVEMDGDEMTRVIWKSIKDKLILPFLELDIKYYDLGLPYRDETDDKVTIESAEATLKYNVAIKCATITPDEARVKEFGLKSMWKSPNGTIRNILNGTVFREPILCKNIPRLVPGWTKAICIGRHAFGDQYRATDTVIKGAGKLKLVFVPEGQGEETEFEVFNFTGEGGVSLAMYNTDESIRSFAEASMATALEKKWPLYLSTKNTILKKYDGRFKDIFQEVYEASWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNAKLLDFTEKLEAACIGVVEAGKMTKDLALILHGSKLSREHYLNTEEFIDAVAAELSARLSA

SEQ ID NO: 3222 - protein, 416 aa, Selaginella moellendorffii
MAFEKIKVENPIVEMDGDEMTRIIWQMIKDKLIFPFLDLDIKYFDLGLPRRDETDDKVTVESAEATLKYNVAIKCATITPDEARVKEFGLKAMWKSPNGTIRNILNGTVFREPIVCKNVPRLVPGWTKPICIGRHAFGDQYRATDTVIKGSGKLKLVFVPENGEASEFEVYDFKGDGGVALSMYNTDESIRSFAQASMTTALAKKWPLYLSTKNTILKKYDGRFKDIFQEVYEAEWKSKFEEAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLSHRATLDGNARLSDYAEKLEAACVGIVESGKMTKDLALLIHGPKVTKKDYLNTEEFIDAVAADLKLRLTTAPSKL

SEQ ID NO: 3223 - protein, 409 aa, Selaginella moellendorffii
NPIVEMDGDEMTRIIWQMIKDKLIFPFLDLDIKYFDLGLPHRDETDDKVTVESAEATLKYNVAIKCATITPDEARVKEFGLKAMWKSPNGTIRNILNGTVFREPIVCKNVPRLVPGWTKPICIGRHAFGDQYRATDTVIKGSGKLKLVFVPENGEASEFEVYDFKGDGGVALSMYNTDESIRSFAQASMTTALAKKWPLYLSTKNTILKKYDGRFKDIFQEVYEAEWKSKFEEAGIWYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLSHRASLDGNARLSDYAEKLEAACVGIVESGKMTKDLALLIHGPKVTKKDYLNTEEFIDAVAADLKLRLTTVPSKLEA

SEQ ID NO: 3224 - protein, 418 aa, Picea glauca
MASEKIKVQNPIVEMDGDEMTRVIWTMIKDKLIFPFVELDIKYFDLGLPHRDATDDKVTVESAEATLKYNVAIKCATITPDEARVKEFGLKAMWKSPNGTIRNILNGTVFREPILCKNVPKLVPGWTKPICIGRHAFGDQYKATDTVIQGPGKLKLVFVPEKGGETTELEVYNFKGDGGVALAMYNTDESIRSFAEASMAVALEKKWPLYLSTKNTILKKYDGRFKDIFQEVYESNWKTKYEEAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDGNARLLEFSEKLEVACIGTVEAGKMTKDLALIIHGSKLSREHYLNTEEFIDAVAEDLKIRLSAKPKLSS

SEQ ID NO: 3225 - protein, 385 aa, Fragaria vesca
MAFEKIKVANPIVEMDGDEMTRIFWQSIKDKLILPFLDLDIKYFDLGLTHRDATDDKVTIESAEATLKYNVAIKCATITPDEARMKEFNLKQMWRSPNGTIRNILNGTVFREPILCKNIPRLIPGWTKPICIGRHAFGDQYRATDTVIKGPGKLKLMFVPEGQDEKMEFEVFNFTGEGGVAIAMYNTDESIRAFAEASMNTAYEKKWPLYLSTKNTILKKYDGRFKDIFQEVYEAHWKSKYEAAGIWYEHRLIDDMVAYALKSEGGYVWACKNYDGDVQSDFLAQGFGSLGLMTSVLVCPDGKTIEAEAAHGTVTRHYRVHQRGGETSTNSIASIFAWTRGLAHRAKLDDNAKLLEFTQKLGEACIGTVESGKMTKDLAPNSSWT

SEQ ID NO: 3226 - protein, 415 aa, Saccharum officinarum
MTFNKIQVANPVVEMDGDEMTRVFWKSIKDKLIFPFVDLDIKYFDLGLPYRDATDDKVTVEAAEATLKYNVAIKCATITPDEARVKEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFAEASMATAYEKKWPLYLSTKNTILKKYDGRFKDIFQEVYEAGWKTKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSANVTRSHYLNTEEFIDAVADELRSRLAANSNL

SEQ ID NO: 3227 - protein, 412 aa, Saccharum officinarum
MAFEKIKVSNPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSSNVTRSHYLNTEEFIDAVATELRSRLGAN

SEQ ID NO: 3228 - protein, 416 aa, Helianthus annuus
  misc_feature (37)..(37): Xaa can be any naturally occurring amino acid
MSFAKIKVENPIVEMDGDEMTRVFWQSIKDKLIFPFXDLDIKYYDLGLPNRDATDDKVTIESAEATLKYNVAIKCATITPDEARMKEFTLKSMWKSPNGTIRNILNGTVFREPILCKNIPKLVPGWTKPICIGRHAFGDQYKATDAVIKGPGKLKLVFVPEGEGENIDLEVYNFTGAGGVALSMYNTEESIAAFAEASMNTAYQKKWPLYLSTKNTILKKYDGRFKDIFQDVYESNWKSKFEAAGIWYEHRLIDDMVAYALKSDGGYVWACKNYDGDVQSDMLAQGFGSLGLMTSVLVCPDGKTIESEAAHGTVTRHYRVHQKGGETSTNSIASIFAWTRGLAHRAKLDNNAKLLDFTEKLEAACIGTVESGKMTKDLALIIHGSKLSREHYLNTEEFIDAVADELKARLVGKSSL

SEQ ID NO: 3229 - protein, 413 aa, Helianthus annuus
MAFEKIKVANPIVEMDGDEMTRVFWESIKNKLIFPFLDLDIKYYDLGLLNRDATDDKVTVESAEATLKYNVAIKCATITPDEARMKEFTLKSMWKSPNGTIRNILNGTVFREPILCKNIPRLIPGWTKAICIGRHAFGDQYKATDAVIKGPGKLKMVFVPEGEGENTELEVYNFTGAGGVALSMYNTDESITAFAEASMNTAYLKKWPLYLSTKNTILKKYDGRFKDIFQEVYERNWKSKFEAAGIWYEHRLIDDMVAYALKSDGGYVWACKNYDGDVQSDMLAQGFGSLGLMTSVLVCPDGKTIESEAAHGTVTRHYRVHQKGGETSTNSIASIFAWTRGLAHRAKLDDNAKLLDFTEKLEAACIGCVESGKMTKDLALIIHGSKLSREHYLNTEEFIDAVADELKARLSSK

SEQ ID NO: 3230 - protein, 412 aa, Panicum virgatum
MAFEKIKVANPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAAASMTTAYEKKWPLYLSTKNTILKKYDGRFKDIFQEVYEADWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNDRLLDFALKLEAACVGTVESGKMTKDLALLVHGSSNVTRSHYLNTEEFIDAVAAELQSKLAAN

SEQ ID NO: 3231 - protein, 415 aa, Panicum virgatum
MAFNKIKVANPVVEMDGDEMTRVFWKSIKDKLIFPFLDLDIKYFDLGLPHRDATDDKVTVEAAEATLKYNVAIKCATITPDEARVKEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFAEASMATAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAANSNL

SEQ ID NO: 3232 - protein, 415 aa, Panicum virgatum
MAFNKIKVANPVVEMDGDEMTRVFWKSIKDKLIFPFLDLDIKYFDLGLPHRDATDDKVTVEAAEATLKYNVSIKCATITPDEARVKEFGLKAMWKSPNGTIRNILNGTVFREPIICKNIPRLVPGWTKPICIGRHAFGDQYRATDAVIKGPGKLKLVFEGKEEQVELEVFNFTGAGGVALSMYNTDESIHAFAEASMATAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACIGAVESGKMTKDLALLVHGSSNVTRSHYLNTEEFIDAVADELRSRLAANSNL

SEQ ID NO: 3233 - protein, 412 aa, Panicum virgatum
MAFEKIKVANPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAAASMTTAYEKKWPLYLSTKNTILKKYDGRFKDIFQEVYEADWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSSNVTRSHYLNTEEFIDAVAAELRSKLASN

SEQ ID NO: 3234 - protein, 329 aa, Thellungiella halophila
MAFEKIKVANPIVEMDGDEMTRVIWKSIKDKLITPFVELDIKYFDLGLPHRDATDDKVTVESAVATKKYNVAIKCATITPDEGRVTEFGLKQMWRSPNGTIRNILNGTVFREPIICKNVPKLVPGWTKPICIGRHAFGDQYRATDAVIKGPGKLTMVFEGKDGKTETEVFTFTGEGGVAMAMYNTDESIRAFAEASMNTAYEKKWPLYLSTKNTILKKYDGRFKDIFQEVYEASWKSKYEAAGIWYEHRLIDDMVAYALKSEGGYVWACKNYDGDVQSDFLAQGFGSLGLMTSVLVCPDGKTIEAEAAHGTVTRHYRVHQKGGETSTTA

SEQ ID NO: 3235 - protein, 395 aa, Nicotiana tabacum
MAFQKIKVVNPIVEMDGDEMTRVIWKLIKDKLIFPFVELGIKYFDLGLPHRDATDDKVTVESAEATLKYNVAIKCATITPDEGRMKEFNLKHMWKSPNGTIRNILNGTVFREPILCKNVPRLVPGWSKPICIGRHAFGDQYRATDTVIQGPGKLKLVFVPEGKDEKTEFEVYNFTGAGGVALSMYNTDESISSFAEASMNMAYQKKWPLYLSTKNTILKKYDGRFKDIFQEVYESNWKLKFEEAGIWYEHRLIDDMVAYALKSDGGYVWACKNYDGDVQSDFLAQGFGSLGLMTSILICPDGKTIESEAAHGTVTRHYRVHQKGGETSTNSIASIFAWTRGLAHRAKLDNNAALLDFSKKLEAACIGAVENGKMTKDLALIVHGSKVARHQYVNT

SEQ ID NO: 3236 - protein, 415 aa, Nicotiana tabacum
MAFDKIKVENPIVEMDGDEMTRVIWKSIKDKLICPFLELDIKYFDLGLPHRDATDDKVTVESAEATQKYNVAIKCATITPDEARVKEFNLKSMWRSPNGTIRNILNGTVFREPIMCKNIPRLVPGWTKPICIGRHAFGDQYRATDTVIQGAGKLKLVFVPEGTDEKTEFEVYNFTGAGGVALSMYNTDESIRSFAEASMNMAYQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSRDHYLNTEEFIDAVADELKARLLKAKA

SEQ ID NO: 3237 - protein, 415 aa, Solanum lycopersicum
MAFQKIKVANPIVEMDGDEMTRVIWKLIKDKLILPFLELDIKYFDLGLPHRDATDDKVTIESAEATLKYNVAIKCATITPDEARMNEFNLKHMWKSPNGTIRNILNGTVFREPILCKNIPRLVPSWSKPICIGRHAFGDQYRATDTVIQGAGKLKLVFVPEGTDEKTEFEVYNFTGAGGVALSMYNTDESICSFAEASMNMAYQKKWPLYLSTKNTILKKYDGRFKDIFQEVYESKWKSKFEEAGIWYEHRLIDDMVAYALKSDGGYVWACKNYDGDVQSDFLAQGFGSLGLMTSILICPDGKTVEAEAAHGTVTRHYRVHQKGGETSTNSIASIFAWTRGLAHRAKLDNNTALLDFTKKLEAACIGAVENGKMTKDLALIIHGSKVARRQYVNTGEFIDAVADELKARLLKAKI

SEQ ID NO: 3238 - protein, 415 aa, Solanum lycopersicum
MAFQKIIVQNPIVEMDGDEMTRVIWKSIKDKLILPFLELDIKYFDLGLPHRDATDDKVTIESAEATQKYNVAIKCATITPDEARVKEFNLKSMWRSPNGTIRNILNGTVFREPIMCKNIPRLVPGWTKPICIGRHAFGDQYRATDTVIKGAGKLKLVFVPEGSDEKTEFEVYNFTGAGGVALSMYNTDESVRAFAEASMNMAFQKKWPLYLSTKNTILKKYDGRFKDIFQEVYEANWKSKYEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRATLDNNERLLDFTEKLEAACIGAVESGKMTKDLALIIHGSKLSREHYLNTEEFIDAVADELKAKLLKAKA

SEQ ID NO: 3239 - protein, 412 aa, Triphysaria pusilla
MAFEKIKVANPIVEMDGDEMTRVIWTFIKDKLIFPFVELDIKYFDLGLPHRDATDDKVTVESAEATLKYNVAIKCATITPDEARMEEFKLKSMWRSPNGTIRNILNGTVFREPILCKNVPRLVPGWTKPICIGRHAFGDQYRATDTVIKGPGKLKLVFVPEGKDEKTEFEVFNFTGAGGVALSMYNTDESIRSFADASMNTAYLKKWPLYLSTKNTILKKYDGRFKDIFQEVYESSWKSKFEEAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNAKLLEFTEKLEAACIGVVESGKMTKDLALIIYGTKLTRDNYLNTEEFIDAVADDLKARLTH

SEQ ID NO: 3240 - protein, 414 aa, Triticum aestivum
MAFDKIQVANPIVEMDGDEMTRIIWKWIKDKLIFPFLDLDIKYFDLGLPNRDATGDKVTIESAEATLKYNVAIKCATVTPDEGRVKEFNLKAMWRSPNGTIRNILNGTVFREPIICKNVPRLVPGWTKPICIGRHAFGDQYRATDTIIRGPGKLKLIFDGIEEQIELDVFNFSGAGGVALSMYNTDESIRAFAEASMNVAYQKRWPLYLSTKNTILKKYDGRFKDIFQENYETNWRGRFEDAGIWYEHRLIDDMVAYALKSEGGYVWACKNYDGDVQSDLVAQGFGSLGLMTSVLVCPDGRTVEAEAAHGTVTRHYRVHQKGGETSTNSIASIFAWSTGLAHRAKLDDNKRLLDFTQKLEAACVGTVESGKMTKDLALLIHGPTVSRDKYLNTMEFIDAVAEELRTRLSAKSKL

SEQ ID NO: 3241 - protein, 458 aa, Oryza sativa
MVELAKLLLRRGLAVVIAVPTPPASTADFFSSSAPAVDRMAAANPSISFHHLPPPEYPDPDPDAFLQMLDTMRLTVPPLLAFLRSLPSVAALVLDLFCVDALDAATAAGVPAYFYYTSSAGDLAAFLHLPHHFATTEGSLKDMGKTPLRFPGVPPIPASDMPHTVLDRADRTCATRLGHYGRIPEARGILINSYEWLEARSVRALREGACIPDRPTPPVYCIGPLMAKGEEAANGERHACLSWLDAQPERSVVFLCFGSLGAVSVKQLKEIARGLENSGHRFLWVVRSPPQDPAKFFLPRPEPDLGMLLPEGFTERTRDRGMVVTSWAPQVEVLRHAATAAFVTHCGWNSVLEAASAGVPMLCWPQYAEQRMNKVLLVDGMQLGVVMDGYDEELVKAEEVEKKVRLVMEFEEGKKLRDRLTMAKEMAAKALADGGSSSLAFTEFLKDLNFGNTTKEKA

SEQ ID NO: 3242 - protein, 147 aa, Hordeum vulgare
MAVAEARLRQEKVKKFEDFVDRRLKPDLVNAIAQRDNLFQQQKTFLDLKKNIENLEKNGVTSMRSMVNLGSEVYMQAEVPDTRHIFVDIGLGFHVEFTWQEALQFISVREARLARQIDEYTHLIASIKAQIKMVCEGIRELLQLPAE

SEQ ID NO: 3243 - protein, 149 aa, Brachypodium distachyon
MAMAAVEARLRQEKVKKFEDFVDRRLKPDLLNAIAQRDTLFHQQKTFLDLKMNIENLEKNGVTSMRSMVNLGSEVYMQAEVPDTRHIFVDIGLGFHVEFTWQEALQFISVREARLARQIDEYTHLIASIKAQIKLVCEGIRELLQLPPE

SEQ ID NO: 3244 - protein, 156 aa, Zea mays
MAAAEAWVRQEKVRKFEEFVDQRLKPDLTNAIAQRNKVFEQQKTFLDLKRNIENLERNGVTSMRSMVNLGSEVYMQAEVPDTRHIFVDIGLGFHVEFTWQEALQFISVREARLTRQIDEYTHLIASIKAQIKLVCEGIREVLQLPAEKELSPRNTW

SEQ ID NO: 3245 - protein, 156 aa, Sorghum bicolor
MAAAEAWARQEKVRKFEEFVDQRLKPDLANAIAQRDKVFEQQKTFLDLKRNIENLERNGVTSMRSMVNLGSEVYMQAEVPDTRHIFVDIGLGFHVEFTWQEALQFISVREARLTRQIDEYTHLIASIKAQIKLVCEGIREVLQLPAEKELSPRNTW

SEQ ID NO: 3246 - protein, 156 aa, Saccharum officinarum
  misc_feature (5)..(5): Xaa can be any naturally occurring amino acid
MAAAXAWARQKKVRKFEEFVDQRLKPDLANAIAQRDKVFEQQKTFLDLKRNIENLERNGVTSMRSMVNLGSEVYMQAEVPDTRHIFVDIGLGFHVEFTWQEALQFISVREARLTRQIDEYTHLIASIKAQVKLVCEGIREVLQLPAEKELSPRNTW

SEQ ID NO: 3247 - protein, 156 aa, Panicum virgatum
MAAAETRARQEKVRKFEEFVDQRLKPDLANAIKQRNKVFEQQKTFLDLKRNIENLERNGVTSIRSMVNLGSEVYMQAEVQDTRHIFVDIGLGFHVEFTWQEALQFISVREARLARQIDEYTHLIASIKSQIKLVCEGIRELLQLPPETELSPRNTW

SEQ ID NO: 3248 - protein, 165 aa, Panicum virgatum
MAVAVAVAEARARQEKVRKFEEFVDQHLKPDLANAIKQRDKVFEQQKTFLDLKRNIENLEMNGVTSMRSMVNLGSEVYMQAEVPDTRHIFVDIGLGFHVEFTWQEALQFISVREARLARQIDEYTHLIASIKAQIKLVCEGIRELLQLPPETELSPRNTWYNNRI

SEQ ID NO: 3249 - protein, 152 aa, Panicum virgatum
ETRTRQEKVRKFEEFVDRRLKPDLANAIKQRDKVFEQQKTFLDLKRNIENLERNGVTSIRSMVNLGSEVYMQAEVPDTRHIFVDIGLGFHVEFTWQEALQFISVREARLARQIDEYTHLIASIKAQIKLVCEGIRELLQLPPETELSPRNTW

SEQ ID NO: 3250 - protein, 216 aa, Triticum aestivum
  misc_feature (131)..(131): Xaa can be any naturally occurring amino acid
SHRRQAFNLLPSAVPSTASSRRAHGRLPAPEAAPKPPTDGKKCCRSRCPVRHYISRGSRTSKETVGDMAMTVAEARLRQDKVKKFEDFVDRRLKPDLVNAIAQRDNLFQQQKTFLDLKKNIENLGKEWCNXHGSMVNLGSEVYMQAEVPDTRHIFVDIGLGFHVEFTWQEALQFISVREARLARQIDEYTHLIASIKAQIKMVCEGIRELLQLAAE

SEQ ID NO: 3251 - protein, 505 aa, Hordeum vulgare
MYRAASGLGALKRHGADTQMLDIAVRSASTSVAQRSSGGFLGWLTGARSNALPPPDFALPGVTIPPPLADHVEPGKTKVTTLPNGVKIASETSPGSSCSVGVYVNCGSVYETPETLGATQLLKKLAFTTTRNRSQLRVVREIGAIGGSAKVSANRELMSYSYGALKTYMPEMVEVLVDCVRNPALLDWEVKEEIMKLKAELAEASSNPEAFLLDALHSSGYSGALANPLIASESSISRLNTDVLEEFLALNYTSPRIVLAASGVDHDELVSIAEPLLSDIRTATGTVKPKSVYVGGEYRRAADSSNTDLALAFELPGGWLKEKEFATASVLQALLGGGGVFTWGRPGKGLHSRLNPLVNEFDEIKSISAFKNVHSNTGIFGIHASTDAAFVPKVIDLAARELTSLATPGQVDQTQLDRAKASAKSVILRNLESKASTTEDMGRQALAFGERKPVEQLLKAVDAITLADVSTVAAKIISSPLTMASHGNVLSVPAYETVRGKFSSK

SEQ ID NO: 3252 - protein, 505 aa, Brachypodium distachyon
MYRAASGLGALKRHGADAQMLNLAIRSASTSVAQRSSGGFWTWLTGARSNALPPPDFPLPGVTIPPPLPDHVEPGKTRVTTLPNGVKIASETSPGSTCSVGVYVNCGSVYEAPETLGATQLLKKLAFTTTTNRSHLRVVREIDAVGGKASASANREMMSYSYAALKTYMPEMVEVLVDSVRNPALLDWEVKEQIMKLKAELAEASSNPETFLLEALHSTGYSGALANPLIASESSISRLNTDVLEDFLAENYTSSRIVLAASGVDHDELVSIAEPLLSDIAKAASTIKPKSDYVGGEYRRTADSAKTDVALAFEIPGGWLREKDFVTVSVLQTLLGGGGVFSWGRSGKGLHSRLNRLVNEFDQIKSISAFKDVHSNTGIFGIHTSTEAAFVPKAIDLAARELTSLATPGQVDQTQLDRAKASAKSAILTSLESKASATEDMGRQVLAFADRKPVEHLLKVLDGVTLKDVSTFAEKIISSPLTMASHGNVLNVPTYDTVRGKFSSK

SEQ ID NO: 3253 - protein, 505 aa, Zea mays
MYRVASGLGALKRHGANAQMMNAAIRCASTSVAQRSSGGFWTWLTGARSNEIPPPDFTLPGVTIPPPLPDHVEAGKTRVTTLPNGVKIASETSAGSSCSVGVYVDCGSVYEAPETTGASQLLKTMAFTTTANRSELRVVREIEAIGGSAKASASREMMSYTYGALKTYMPEMVEVLIDCVRNPAFLDWEVKEQILRLQAELAKSSSYPENFLLEALHSTGYSGALANPLIVPEYSVSRLNADVLEQFITENYTASRIVLAASGVDHDELVSIAEPLLSDIPSVSGTTRPKSTYIGGEYRRSADSSNTDVALAFEVPSGWLKEKDCVTVSVLQALLGGGGKFSWGRQGKGLHSRLNRLVNEFDQIKSISAFKDVHSNTGIFGIHTSTDASFVPKAIDLAARELTSLATPGQVDQSQLDRAKASAKSAILANLESQASLTEDMGRQVLAFGERKPAEHLLKAVDGVTMKDITSVAEKIISSPLTMASHGNVLNMPTYESVSGKFRSK

SEQ ID NO: 3254 - protein, 505 aa, Pennisetum glaucum
MYRAVSSLRAIKRHRADAQMMNIAIRSASTSVARSSSGGLWTWLTGARSNALPPPDFELPGVTIPPPLPDLVEPGKTKITTLDNGVKIASETSAGPSCSVGVYVDCGSVYEAPETTGASQLLKTLAFSTTTNRSELRVVREIEAIGGIAKASASREMMSYTYGALKTYMPEMVEVLIDCVRNPAFLDWEVKEQILKLKAELAKASSNPEKLLLEALHSTGYSGALANPLIAPESSISRLNADVLEQFIAENYTAPRIVLAASGVDHDELVSIAGPLLSDIPNVAGTTRPKSTYVGGEYRRTADSSNTDVALAFEVPSGWLKEKDFVTVSILQTLLGGGGTFSWGRQGKGLHSRLNHLVNEFDQIKSISAFKDVHSNTGIFGIHTSTDASFVPKAIDLAARELISLATPGQVEQSQLDRAKASAKSAILVNLESKASLTEDMGRQVLAFGERKPVEHLLKAVDAVTLEDVTAAAEKIISSPLTMASHGNVLNMPTYESVSGKFSSK

SEQ ID NO: 3255 - protein, 505 aa, Sorghum bicolor
MYRVASGLGALKRHGADAQMMNVAIRCASTSVAQGSSGGFWTWLTGARSNEIPPPDFALPGVTIPPPLPDHVEAGKTIVTTLPNGVKIASETSAGSSCSVGVYVDCGSVYEAPETTGASQLVKTMAFATTANRSELRVVREIDAIGGTAKASASREMMSYTYRALKTYMPEMVEVLIDCVRNPAFLDWEVKEQILRLKAELVKSSSNPEKFLLEALHSTGYSGALANPLIASEYAISRLNSDVLEQFIIENYTAPRIVLAASGVDHEELVSIAGPLLSDIPSVSGTTRPKSTYIGGEYKKSADSSNTDVALAFEVPSGWLKEKDFVTASVLQTLLGGGGKFSWGRQGKGLHSRLNHLVNEFDQIKSISAFKDVHSNTGIFGIHTSTDASFVPKAIDLAARELTSLATPGQVDQSQLDRAKASAKSAILANLESQASLTEDMGRQVLAFGERKPAEHLLKAIDGVTLKDVTSVAEKIISSPLTMASHGNVLNMPTYESVSGKFRSK

SEQ ID NO: 3256 - protein, 504 aa, Saccharum officinarum
MYRVASGLGALKRHGADAQMMNVAIRCASTSVAQGSSGGFWTWLTGARSNEIPPPDFTLPGVIIPPPLPDHVEAGKTRVTTLPNGVKIASETSAGSSCSVGVYVDCGSVYEAPETTGASQLLKTMAFATTANRSELRVVREIEAIGGSAKASASREMMSYTYGALKTYMPEMVEVLIDCVRNPAFLDWEVKEQILRLKAELAKSSSNPEKFLLEALHSTGYSGALANPLIASEYAISKLNADVLEQFIIENYTAPRIVLAASGVDHDELVSIAEPLLSDIPSVSGTRPKSTYIGGEYRRSADSSNTDVALAFKVPSGWLKEKDFVTVSVLQTLLGGGGKFSWGRQGKGLHSRLNHLVNEFDQIRSISAFKDVHSNTGIFGIHTSTDASFVPKAIDLAARELTSLATPGQVDQSQLDRAKASAKSAILANLESQASLTEDIGRQVLAFGERKPAEHLLKAIDGVTLKDVTSVAEKIISSPLTMASHGNVLNMPTYESVSGKFRSK

SEQ ID NO: 3257 - protein, 505 aa, Panicum virgatum
MHRAVSGLSALKRHRADAQMMNIAIRSASTSVAQSSSGGFWTWLTGARSNALPPPDFALPGVTIPPPLPDLVEPGKTKITTLSNGVKIASETSAGSSCSVGVYIDCGSVYEAPETTGVSQLLKTMAFATTTNRSELRVVREIEAIGGSAKASASREMMSYTYGALKTYMPEMVEVLVDCVRNPAFLDWEVKEQILRLKAELAKASSNPENFLLEALHSTGYSGALANPLIASESLISRLSTDVLGQFIFENYTAPRIVLAASGVDHDELVSIAEPLLSDIPSVTGTTRPKSTYVGGEYRRTADSSNTDVALAFEVPGGWLKEKDFATVSVLQTLLGGGGTFSWGRQGKGLHSRLNHLVTEFDQIKSISAFKDVHSNTGIFGIHTSTDASFVPKAIDLAARELTSLATPGQVDQSQLDRAKASAKSAILVNLESKASLTEDMGRQVLAFGERKPVEHLLKAVDGVTLKDVTTVAEKIISSPLTMASHGNVLNMPTYESVSGKFSSK

SEQ ID NO: 3258 - protein, 505 aa, Panicum virgatum
MRRAVSGLSALKRHRADAQMMNIAIRSASTSVAQSSSGGFWTWLTGARSNALPPPDFALPGVTIPPPLPDLVEPGKTKITTLSNGVKIASETSAGSSCSVGVYIDCGSVYEAPETTGVSQLLKTMAFVTTTNRSELRVVREIEAIGGSAKASASREMMSYTYGALKTYMPEMVEVLIDCVRNPAFLDWEVKEQILRLKAELAKASSNPEKLLLEALHSTGYSGALANPLIASESSISRLNTDVLEQFIFENYTAPRIVLAASGVDHDELVSIAEPLLSDIPNVTGTTRPKSTYVGGEYRRTADSLNTDVALAFEVPGGWLKEKDFATVSVLQTLLGGGGTFSWGRQGKGLHSRLNHLVTEFDQIKSISAFKDVHSNTGIFGIHASTDASFVPKAIDLAARELTSIATPGQVDQSQLDRAKASAKSAILVNLESKASLTEDMGRQVLAFGERKPVEHLLKAVDGVTLKDVTTVAEKIISSPLTMASHGNVLNMPTYESVRGKFSSK

SEQ ID NO: 3259 - protein, 505 aa, Triticum aestivum
MYRAASGLGALKQHGADTQLLNIAVRSASTSVAQRSSGGFLGWLTGARSNALPPPDFALPGVTIPPPLADHVEPGKTKITTLSNGVKIASETSPGSACSVGVYVHCGSVYETPETLGATQLLKKLAFTTTRNRSQLRVVREIGAIGGSAKASANRELMSYSYGALKTYMPEMVEVLVDCVRNPALLDWEVKEEIMKLKAELAEASSNPEAFLLDALHSSGYSGALANPLIASEASISRLNTDVLEEFLALNYTSPRIVLAASGVDHDELVSIAEPLLSDIPTATGTGKPKSVYVGGEYRRAADSSNTDLALAFELPGGWLKEKEFATASVLQALLGGGGVFTWGRPGKGLHSRLNPLVNEFDQIKSISAFKNVHSNTGIFGIHTSTEAAFVPKVIDLAARELTSLATPGQVDQTQLERAKAFAKSAILKNLESKASTTEDMGRQALAFGERKPVEQLLKAVDAITLADVSTVAEKIISSPLTMASHGNVLNVPAYETVRGKFSSK

SEQ ID NO: 3260 - protein, 360 aa, Brachypodium distachyon
MADGGGLEEQAAAAAEAARELREAAAGMAARRAAEEDALRRRAAALDGDVRRLQGSLASLDPATLEKVEEDLERARAAILDGDVAGLLPSKGSGKFLKKFLGPVNVRVARKEDKLKVKDEYNNYRDRAAYIFLLFPSTLLLLRWWVWDGCLPALAVQVYQAWLLFLYTSFALRENVLLVNGSDIRPWWIYHHYLAMLMALVSLTWEIKGQPDCSSKQRGVQLFLRWAIMQGIAMHLQNRYQRQRLRTRIALGKAKRMDVVAGETAGVEGQLLLLYPVLFVLQGFEAYVGVLLLQTAWHGLTSEWQVVVCGILLVVMAVGNFVNTVETLALKLRFKAKMKRTRNRPDQSQGQGGPNRPHQN

SEQ ID NO: 3261 - protein, 354 aa, Zea mays
MSGDGDARGLEAAAATAAEAARELREAAAALVATRAAEEDALRRRAVALEADVRRLQASLHALDPSTLDKVEEELERARVAITDSDVASFLPSKRNGKFLKTFLGPVNVRVARKEDKLKIKDEYNNYRDRTAYKFLLFPSILLLLRWWIWDGCLPALAVQIYQAWLLYLYTSFALRENVLIANGSDIRPWWIYHHYLAMLMALISLTWEIKGQPDCSSKQRGVQLFLRWAIMQGIAMHLQNRYQRQRLRTRIALGKAKRMDVVAGETAGVEGQLLLLYPVLFILQGFEAYVGVLLLQTALHGLASEWQVLVCGILLVVMAVGNFVHTMETLVLKLRFKAKMKKAKSRQDRPHQN

SEQ ID NO: 3262 - protein, 354 aa, Sorghum bicolor
MSGDGDARGLEAAASAAAEAARELREAAAALVATRAAEEDALRRRAVALDADVRRLQGSLHALDSSTIDKVEEELERARVAITDSDVASFLPSKRNGKFLKTFLGPVNVRVARKEDKLKIKDEYNNYRDRTAYKFLLFPSILLLLRWWIWDGCLPALAVQIYQAWLLYLYTSFALRENVLIANGSDIRPWWIYHHYLAMLMALISLTWEIKGQPDCSSKQRGVQLFLRWAIMQGIAMHLQNRYQRQRLRTRIALGKAKRMDVVAGETAGVEGQLLLLYPVLFILQGFEAYVGVLLLQTALHGLASQWQVVVCGILLVVMAVGNFVNTMETLLLKLRFKAKMKRAKNRQDRPHQN

SEQ ID NO: 3263 - protein, 325 aa, Panicum virgatum
ALVATRAAEEDALRRRAVALDADVRRLQGSLPALDPSAVDKIEEELERAKAAITDSDVASFLPSKRNGKFLKMFLGPVNVRVARKEDKLKIKDEYNNYRDRTAYKFLLFPSILLLLRWWIWDGCLPAWAVQIYQAWLLFLYTSFALRENVLIANGSDIRPWWIYHHYLAMVMALISLTWEIKGQPDCSSKQRGVQLFLRWAIMQGIAMHLQNRYQRQRLRTRIVLGKAKRMDVVAGETAGVEGQLLLLYPVLFILQGFEAYVGVLLLQTALHGLASEWQVVVCGILLVVMAVGNFVNTVETLILKLRFKAKMKRAKSRQDRPHQN

SEQ ID NO: 3264 - protein, 388 aa, Triticum aestivum
EASLSLQPPPPPPRRTAHLSCSSSAAMDGGGDGAQGLEEQAAAAAEAARELRDAAAALAVRRAADEDALRRRAVAIDADVRRLQGSLAPLDPATLDKVEEELERARAAILDGDVAAFLPSKGNGKFLKKFVGPVNVRVARKEDKLKVKDEYNNYRDRAAYMFLLFPSTLLLLRWWVWDGCLPALAVQVYQAWLLFLYTSFALRENVLLVNGSDIRPWWIYHHYLAMLMALVSLTWEIKGQPDCSSKQRGVQLFLRWAIMQGIAMHLQNRYQRQRLRTRIALGKAKRMDVVAGETAGVEGQLLLLYPVLFVLQGFEAYVGVLLLQTAWHGLTSEWQVIVCGILLVVMAVGNFVNTVETLALKLRFKAKMKRTRHRQEPGQGGANRLHQN

SEQ ID NO: 3265 - protein, 316 aa, Oryza sativa
MARRWPPLVVGLALLLLLSVAASSVVAKTDQPDVAALNVMFESMNKPSELLGWKASGGDPCGDDDEWKGIECSDSSVTEINLSGLGLSGTLGYQLSSLKSVTKFDVSKNNLNGEIPYQLPPNVVQLNLRGNAFSGGVPYSISQMTDLETLNLGKNQLSGQLTDMFSQLPKLTTMDLSFNSFSGNLPPSFQYLKNLKTLDVESNQFSGHINVLAKLSLEDLNVKNNKFTGWIPSKLKSIDNLETGGNSWSSGPAPPGMEKESSAGSSNGRDDSGINGFAIGAMVIAVLLAALILLSVLRRNHSSPVSSHYYTDESGP

SEQ ID NO: 3266 - protein, 161 aa, Antirrhinum majus
MIHFVLLISRQGKVRLTKWYSPYSQKERTKVIRELSGTILTRGPKLCNFVEWRGYKVVYKRYASLYFCMCIDQDDNELEVLEIIHLFVEILDRYFGSVCELDLIFNFHKAYYILDEILIAGELQESSKKTVARLIAAQDSLVEAAKEEASSISNMIAQATK

SEQ ID NO: 3267 - protein, 161 aa, Malus domestica
MIQFVLLISRQGKVRLTKWYSPYTQKERSKVLRELSGVILARGPKLCNFVDWRGYKVVYKRYASLYFCMCIDQEDNELEVLEMIHHYVEILDRYFGSVCELDLIFNFHKAYYILDEILIAGELQESSKKTVARLIAAQDSLVETAKEQASSISNIIAQATK

SEQ ID NO: 3268 - protein, 161 aa, arabidopsis lyrata
MIHFVLLVSRQGKVRLTKWYSPYTQKERSKVIRELSGVILNRGPKLCNFIEWRGYKVVYKRYASLYFCMCIDEADNELEVLEIIHHYVEILDRYFGSVCELDLIFNFHKAYYILDELLIAGELQESSKKTVARIISAQDQLVEAAKEEASSISNIIAQATK

SEQ ID NO: 3269 - protein, 161 aa, Arabidopsis thaliana
MIHFVLLVSRQGKVRLTKWYSPYTQKERSKVIRELSGVILNRGPKLCNFIEWRGYKVVYKRYASLYFCMCIDEADNELEVLEIIHHYVEILDRYFGSVCELDLIFNFHKAYYILDELLIAGELQESSKKTVARIISAQDQLVEVAKEEASSISNIIAQATK

SEQ ID NO: 3270 - protein, 162 aa, Arabidopsis thaliana
MIHFVLLVSRQGKVRLTKWYSPYAQKERSKVIRELSGVILNRGPKLCNFVEWRGYKVVYKRYASLYFCMCIDQEDNELEVLEIIHHYVEILDRYFGSVCELDLIFNFHKAYYILDELLIAGELQESSKKTVARIISAQDQLVEVAKEEASSISNIIAQATNR

SEQ ID NO: 3271 - protein, 161 aa, Brassica oleracea; identical to SEQ ID NO: 3268

SEQ ID NO: 3272 - protein, 161 aa, Brassica rapa; identical to SEQ ID NO: 3268

SEQ ID NO: 3273 - protein, 176 aa, Musa acuminata
MIHFVLLISRQGKVRLTKWYSPYSQKERTKVIRELSGLILARGPKLCNFVEWRGYKVVYRRYASLYFCMCIDADDNELEILEIIHHFVEILDRYFGSVCELDLIFNFHKAYYILDEILIRWGTPRVKQEDRCSAYSCTRLTGGSCKGAGKFCKQYDCTGHQIGFLQFLYHNSLQTC

SEQ ID NO: 3274 - protein, 161 aa, Hordeum vulgare
MINFVLLISRQGKVRLTKWYSPYTQKERTKVIRELSGLILTRGPKLCNFVEWRGYKVVYRRYASLYFCMCIDADDNELEVLEIIHHFVEILDRYFGSVCELDLIFNFHKAYYVLDEILISGELQESSKKNVARLIAAQDSLVEAAKEEAGSISNIIAQATK

SEQ ID NO: 3275 - protein, 124 aa, Ocimum basilicum
MILTRAPKLCNFVEWRGYKVVYKRYASLYFCMCIDENDNELEILEIIHHYVEILDRYFGSVCELDLIFNFHKAYYILDEILIAGELQESSKKTVARLIAAQDSLVEAAKEQASSISNMIAQATK

SEQ ID NO: 3276 - protein, 161 aa, Phaseolus coccineus
MIQFVLLISRQGKVRLTKWYSPYSQKERNKAIREISGLVLTRAPKLCNFVEWRGHKVVYKRYASLYFCMCMDEEDNELEVLEIIHHFVEILDRYFGSVCELDLIFNFHKAYYILDELLIAGELQESSKKTIARLIAAQDSLVETAKEEASSLSNIISQATK

SEQ ID NO: 3277 - protein, 161 aa, Brachypodium distachyon
MINFVLLISRQGKVRLTKWYSPYTQKERTKVIRELSGLILTRGPKLCNFVEWRGYKVVYRRYASLYFCMCIDADDNELEVLEIIHHFVEILDRYFGSVCELDLIFNFHKAYYVLDEILIAGELQESSKKNVARLIAAQDSLVEAAKEEASSISNIIAQATK

SEQ ID NO: 3278 - protein, 161 aa, Brassica napus; identical to SEQ ID NO: 3268

SEQ ID NO: 3279 - protein, 167 aa, Manihot esculenta
SCYCVFQIHFVLLISRQGKVRLTKWYSTYSQKERTKVIRELSGVILSRGPKLCNFVEWRGYKVVYKRYASLYFCMCIDQDDNELEVLEIIHHYVEILDRYFGSVCELDLIFNFHKAYYILDELLIAGELQESSKKTVARLIAAQDSLVEAAKEQASSISNIIAQATK

SEQ ID NO: 3280 - protein, 161 aa, Manihot esculenta
MIHFVLLISRQGKVRLTKWYSPYSQKERTKVIRELSGVILTRGPKLCNFVEWRGYKVVYKRYASLYFCMCIDQDDNELEVLEIIHHYVEILDRYFGSVCELDLIFNFHKAYYILDELLIAGELQESSKKTVARLIDAQDSLVETAKEQASSISNIIAQATK

SEQ ID NO: 3281 - protein, 161 aa, Ricinus communis
MIQFVLLISRQGKVRLTKWYSPYSQKERTKVIRELSGVILTRGPKLCNFVEWRGYKVVYKRYASLYFCMCIDQDDNELEVLEIIHHFVEILDRYFGSVCELDLIFNFHKAYYILDELLIAGELQESSKKTVARLIAAQDSLVETAKEQASSISNIIAQATK

SEQ ID NO: 3282 - protein, 161 aa, Catharanthus roseus
MIHFVLLISRQGKVRLTKWYSPYTQKERTKVIRELSGLILTRGPKLCNFVEWRGFKVVYKRYASLYFCMCIDQEDNELEVLEIIHHYVEILDRYFGSVCELDLIFNFHKAYYILDELLIAGELQESSKKTVARVIAAQDSLVEAAKEQASSLSNMIAQATK

SEQ ID NO: 3283 - protein, 161 aa, Centaurea maculosa
MIHFVLLISRQGKVRLTKWYSPYSQKERSKVIRELSGMILTRGPKLCNFVEWRGFKVVYKRYASLYFCMCINQEDNELEILEIIHHYVEILDRYFGSVCELDLIFNFHKAYYILDEVLIAGELQESSKKTVARLVAAQDSLVEAAKEEANSISNIIAQATK

SEQ ID NO: 3284 - protein, 161 aa, Centaurea maculosa
MIHFVLLISRQGKVRLTKWYSPYSQKERSKVIRELSGMILTRGPKLCNFVEWRGFKVVYKRYASLYFCMCINQEDNELEILEIIHHYVEILDRYFGSVCELDLIFNFHKAYYILDEVLIAGELQESSKKTVARLVASQDSLVEAAKEEANSISNIIAQATK

SEQ ID NO: 3285 - protein, 161 aa, Castanea mollissima
MIHFVLLISRQGKVRLTKWYSPYTQKERTKVLRELSGVILTRGPKLCNFVEWRGYKVVYKRYASLYFCMCIDQEDNELEVLEIIHHYVEILDRYFGSVCELDLIFNFHKAYYILDELLIAGELQESSKKSVARLISAQDSLVEMAKEQRSSISNIIAQATK

SEQ ID NO: 3286 - protein, 158 aa, Cicer arietinum
MIHFVLLISRQGKVRLTKWYSPYTQKERSKVIRELSGVILSRAPKLCNFVEWRGHKVVYKRYASLYFCMCIDDEDNELEVLEMIHHFVEILDRYFGSVCELDLIFNFHKAYYILDELLIAGELQESSKKTVARLIAAQDSLVESAKEEASSLSYRTSH

SEQ ID NO: 3287 - protein, 161 aa, Cichorium intybus
MIHFVLLISRQGKVRLTKWYSPYTQKERSKVIRELSGMILTRGPKLCNFVEWRGFKVVYKRYASLYFCMCINQEDNELEVLEIIHHYVEILDRYFGSVCELDLIFNFHKAYYILDEVLIAGELQESSKKTVARLVAAQDSLVEAAKEEANSISNIIAQATK

SEQ ID NO: 3288 - protein, 161 aa, Cichorium intybus
MIHFVLLISRQGKVRLTKWYSPYSQKERSKVIRELSGMILTRGPKLCNFVEWKGFKVVYKRYASLYFCMCINQEDNELEVLEIIHHFVEILDRYFGSVCELDLIFNFHKAYYILDEVLIAGELQESSKKTVARLVSAQDSLVDTAKEEANSISNIIAQATK

SEQ ID NO: 3289 - protein, 161 aa, Citrus sinensis
MIHFVLLISRQGKVRLTKWYSPYTQKERSKVIRELSGVILTRGPKLCNFVEWRGYKVVYKRYASLYFCMCIDQEDNELEILEIIHHYVEILDRYFGSVCELDLIFNFHKAYYILDEILIAGELQESSKKTVARLIAAQDSLVETAKEQASSISNIIAQATK

SEQ ID NO: 3290 - protein, 161 aa, Trifolium pratense
MIHFVLLISRQGKVRLTKWYSPYTQKERSKVIRELSGVILSRAPKLCNFVEWRGHKVVYKRYASLYFCMCIDDTDNELEVLEMIHHFVEILDRYFGSVCELDLIFNFHKAYYILDELLIAGELQESSKKTVARLIAAQDSLVETAKEEASSLSNIIAQATK

SEQ ID NO: 3291 - protein, 161 aa, Vigna unguiculata
MIHFVLLISRQGKVRLTKWYSPYSQKERNKAIREISGVVLTRAPKLCNFVEWRGHKIVYKRYASLYFCMCIDEEDNELEVLEIIHHFVEILDRYFGSVCELDLIFNFHKAYYILDELLIAGELQESSKKTIARLIAAQDSLVETAKEEASSISNIIAQATK

SEQ ID NO: 3292 - protein, 161 aa, cucumber
MIHFVLLISRQGKVRLTKWYSPYTQKERSKVIRELSGMILNRGPKLCNFVEWRGLKAVYKRYASLYFCMCIDQEDNELEVLEIIHHYVEILDRYFGSVCELDLIFNFHKAYYILDELLIAGELQESSKKTVARLIAAQDSLVETAKEQASSISNIIAQATK

SEQ ID NO: 3293 - protein, 161 aa, Taraxacum officinale
MIHFVLLISRQGKVRLTKWYSPYTQKDRSKVIRELSGMILSRGPKLCNFVEWRGFKVVYKRYASLYFCMCINQEDNELEVLEIIHHYVEILDRYFGSVCELDLIFNFHKAYYILDEVLIAGELQESSKKTVARLVAAQDSLVEAAKEEANSISNIIAQATK

SEQ ID NO: 3294 - protein, 161 aa, Eucalyptus gunnii
MIHFVLLISRQGKVRLTKWYSPYSQKERTKVIREISGLMLHRGPKLCNFVEWGGLKVVYKRYASLYFCMCIDPEDNELETLEVIHHFVEILDRYFGSVCELDLIFNFHKAYYILDELVIAGEILESSKKTVARLISAQDSLVEAAKEEASSISNIIAQATK

SEQ ID NO: 3295 - protein, 161 aa, Adiantum capillus-veneris
MIHFVLLISRQGKVRLTKWYSPYTQKERQKAIRELSGLILTRGPKLCNFVEWRGLKVVYKRYASLYFCMCIDPEDNELECLEIIHHFVEILDRYFGNVCELDLIFNFHKAYYILDEVLLAGELQETSKKSVARVIAAQDTLVENAKEQANTLTNIIAQATK

SEQ ID NO: 3296 - protein, 161 aa, Festuca arundinacea; identical to SEQ ID NO: 3277

SEQ ID NO: 3297 - protein, 161 aa, Gerbera hybrid cultivar
MIHFVLLISRQGKVRLTKWYSPYSQKERSKVIRELSGMILTRGPKLCNFVECRGFKVVYKRYASLYFCMCINQEDNELEVLEIIHHFVEILDRYFGSVCELDLIFNFHKAYYILDEILIAGELQESSKKTVARLVSAQDSLVEAAKEEANSISNIIAQATK

SEQ ID NO: 3298 - protein, 161 aa, Vitis vinifera
MIHFVLLISRQGKVRLTKWYSPYTQKERTKVIRELSGVILTRGPKLCNFVEWRGYKVVYKRYASLYFCMCIDQDDNELEVLEIIHHYVEILDRYFGSVCELDLIFNFHKAYYILDELLIAGELQESSKKTVARLIAAQDSLVETAKEEASSISNIIAQATK

SEQ ID NO: 3299 - protein, 161 aa, Vitis vinifera
MIHFVLLISRQGKVRLTKWYSPYSQKERTKVIRELSGVILTRGPKLCNFVEWRGYKVVYKRYASLYFCMCIDQDDNELEVLEIIHHFVEILDRYFGSVCELDLIFNFHKAYYVLDELLIAGELQESSKKTVARLIAAQDSLVETAKEEASSISNIIAQATK

SEQ ID NO: 3300 - protein, 161 aa, Ipomoea nil
MIHFVLLISRQGKVRLTKWYSPYAQKERTKVIRELSGMILTRGPKLCNFVEWRGFKVVYKRYASLYFCMCIDQEDNELEILEIIHHYVEILDRYFGSVCELDLIFNFHKAYYILDELLIAGELQESSKKTVARLIAAQDSLVEAAKEQASSLSNMIAQATK

SEQ ID NO: 3301 - protein, 161 aa, Jatropha curcas
MIHFVLLISRQGKVRLTKWYSPYSQKERTKVVRELSGVILTRGPKLCNFVEWRGYKVVYKRYASLYFCMCIDQDDNELEVLEIIHHFVEILDRYFGSVCELDLIFNFHKAYYVLDELLIAGELQESSKKTVARLIAAQDSLVETAKEQASSISNIIAQATK

SEQ ID NO: 3302 - protein, 161 aa, Lactuca sativa; identical to SEQ ID NO: 3287

SEQ ID NO: 3303 - protein, 161 aa, Liriodendron tulipifera
MIHFVLLISRQGKVRLTKWYSPYTQKERSKVIRELSGVILTRGPKLCNFVEWRGYKVVYKRYASLYFCMCIDEDDNELEVLEIIHHFVEILDRYFGSVCELDLIFNFHKAYYILDELLIAGELQESSKKTVARLIAAQDSLVETAKEEASSISNIIAQATK

SEQ ID NO: 3304 - protein, 93 aa, Zea mays
MRIDADDNELEVLEIIHHFVEILDRYFGSVCELDLIFNFHKAYYILDEILIAGELQESSKKNVARLIATQDSLVEAAKEEASSISNIIAQATK

SEQ ID NO: 3305 - protein, 161 aa, Zea mays
MINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLIFNFHKAYYILDEILIAGELQESSKKNVARLIAAQDSLVEAAKEEASSISNIIAQATK

SEQ ID NO: 3306 - protein, 833 aa, Zea mays
MSICGYHSPRFSENCAFVGHPSQEHQDCQNATDGYSGFILHLSGDEDTVVSSPVSSNVLPFSLRVSSESAAQPSLAEGSGNPQIPNSGTCNGLSESLCADGEEQEVNAVSQNQFEANDPQVDMPTKVARKEISIQPDTIRHRRHGFNGGKVDVRKLRNVDVNDAIELSIAASEAMVIAEMILDDSQPDKSAAAAIEAALHVKEARKQFYFEEPQHACGSSEGGLDEIDWLAELDESEMVDAYQDVALSLIHIACSSQDHNTGDLKQQNSHPTCPPCDADTHILWDSSSERQNKKWNSQNADSDDHVSDSFPNNQSAGVAAQTNVGMKKRVKGLFEEENSYISDSISTDRRCPTSRASSMEIVASSRASLYCKAEGLLEENHHPGTEELCCQVVCSSLSQVDPLCSIVPCSISCDEGPSSQAPVCKQSEGHEGPSNQAPSCKKNEGNEGPTCLTPEREHSKKKEEEFMHTKEFPMMQYLDEEAGPSCVPLVKPADSNVPFRRRKYSSLRPFSTIATKSNIFGSTSNSNADVPVCQLERFTPIVLNKNVQRVQAAKEFIENSAGAENLEDFSAVRKQTYYPQDGSEDQIRELQVPREVFPPTENLVVKQHLKRKRVQFSEAKRSSRRTKNNRRILTKSRFSRSDSRTGEMLETREYTDNKEDTFQGVEFLLTGFPKQKEKEIESLIRKSGGYVLSKVSPFPLDKRKNMAEFPSWNPPIVLSPKKVSTAKFLYGCAIDAWILNPIWLFDSLQAGIMLPPGKYLIRQRNAQKHNSSFDRPLHPKCNTLIFDGVGFLIHGKISFCSKFSNIVKLVSLSNIIFFSHSMEGAKFLYLFRD

SEQ ID NO: 3307 - protein, 161 aa, Medicago truncatula
MIHFVLLISRQGKVRLTKWYSPYTQKERSKVIRELSGVILSRAPKLCNFVEWRGHKVVYKRYASLYFCMCIDDADNELEVLEMIHHFVEILDRYFGSVCELDLIFNFHKAYYILDEILIAGELQESSKKTVARLIAAQDSLVETAKEEASSLSNIIAQATK

SEQ ID NO: 3308 - protein, 161 aa, Cucumis melo
MIHFVLLISRQGKVRLTKWYSPYSQKERSKVIRELSGMILNRGPKLCNFVEWRGLKAVYKRYASLYFCMCIDQDDNELEVLEIIHHYVEILDRYFGSVCELDLIFNFHKAYYILDELLIAGELQESSKKTVARLIAAQDSLVETAKEQASSISNIIAQATK

SEQ ID NO: 3309 - protein, 161 aa, Pennisetum glaucum
MINFVLLISRQGKVRLTKWYSPYTQKERTKVIRELSGLILTRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQATK

SEQ ID NO: 3310 - protein, 93 aa, Pennisetum glaucum
MCIDPADNELETLQIIHHYVEILDRYFGNVCELDLIFNFHKAYFILDEVLIAGELQESNKKAVLRLVTTQDALVEAAKEEASSLSNIIAQATK

SEQ ID NO: 3311 - protein, 161 aa, Mimulus guttatus
MIHFVLLISRQGKVRLTKWYSPYTQKERTKVIRELSGMILTRGPKLCNFVEWRGYKVVYKRYASLYFCMCIDQDDNELEVLEIIHHFVEILDRYFGSVCELDLIFNFHKAYYILDEILIAGELQESSKKTVARLVAAQDSLVEAAKEEASSISNIIAQATK

SEQ ID NO: 3312 - protein, 161 aa, Nuphar advena
MIHFVLLISRQGKVRLTKWYSPYAQKERSKVIRELSGLILTRGPKLCNFVEWRGYKVVYKRYASLYFCMCVDQDANELEILEIIHHFVEILDRYFGSVCELDLIFNFHKAYFILDELLIAGELQEPSKKTVARLIAAQDSLVESAKEQANSLSNIIAQATK

SEQ ID NO: 3313 - protein, 161 aa, Quercus alba; identical to SEQ ID NO: 3285

SEQ ID NO: 3314 - protein, 161 aa, Carica papaya
MIHFVLLISRQGKVRLTKWYSPYSQKERSKIIRELSGVILTRGPKLCNFVEWRGYKVVYKRYASLYFCMCIDQDDNELEILEIIHHFVEILDRYFGSVCELDLIFNFHKAYYILDEILIAGELQESSKKTVARLIAAQDSLVETAKEQASSISNIITQATK

SEQ ID NO: 3315 - protein, 161 aa, Arachis hypogaea
MIHFVLLISRQGKVRLTKWYSPYTQKERSKVIRELSGVILTRAPKLCNFVEWRGYKVVYKRYASLYFCMCIDEDDNELEVLEIIHHYVEILDRYFGSVCELDLIFNFHKAYYILDELLIAGELQESSKKTVARLIAAQDSLVETAKEEASSISNIIAQATK

SEQ ID NO: 3316 - protein, 161 aa, Capsicum annuum
MIHFVLLISRQGKVRLTKWYSPYTQKERTKVIRELSGMILTRGPKLCNFVEWRGYKVVYKRYASLYFCMCIDQEDNELEVLEIIHHFVEILDRYFGSVCELDLIFNFHKAYYILDELVIAGELQESSKKTVARLIAAQDSLVEAAKEEASSLSNIIAQATK

SEQ ID NO: 3317 - protein, 161 aa, Petunia hybrida
MIHFVLLISRQGKVRLTKWYSPYAQKERTKVIRELSGMILTRGPKLCNFVEWRGYKVVYKRYASLYFCMCIDQEDNELEVLEIIHHYVEILDRYFGSVCELDLIFNFHKAYYILDELLIAGELQESSKKTVARLIAAQDSLVEAAKEEASSISNIIAQATK

SEQ ID NO: 3318 - protein, 161 aa, Pinus taeda
MIHFVLLISRQGKVRLTKWYSPYSQKERSKIIREISGVILTRGPKLCNFIEWRGFKVVYKRYASLYFCMCIDADDNELEVLEIIHHFVEILDRYFGSVCELDLIFNFHKAYYILDELLIAGELQESSKKTVARVIAAQDSLVESAKEQASSLSNIIAQATK

SEQ ID NO: 3319 - protein, 161 aa, Pinus taeda; identical to SEQ ID NO: 3318

SEQ ID NO: 3320 - protein, 161 aa, Populus trichocarpa
MIQFVLLISRQGKVRLTKWYSPYTQKERSKVIRELSGVILTRGPKLCNFVEWRGQKVVYKRYASLYFCMCTDQDDNELEVLEIIHHFVEILDRYFGSVCELDLIFNFHKAYYVLDEILIAGELQESSKKTVARLIAAQDSLVETAKEQASSISNIIAQATK

SEQ ID NO: 3321 - protein, 161 aa, Papaver somniferum
MIHFVLLISRQGKVRLTKWYSPYSQKERTKVIRELSGVILTRGPKLCNFVEWRGYKVVYKRYASLYFCMCIDEDDNELEVLEIIHHFVEILDRYFGSVCELDLIFNFHKAYYILDELLIAGELQETSKKTVARLIAAQDSLVETAKEQAGIISNIIAQATK

SEQ ID NO: 3322 - protein, 161 aa, Solanum tuberosum
MIHFVLLISRQGKVRLTKWYSPYTQKERTKVIRELSGMILSRGPKLCNFVEWRGYKVVYKRYASLYFCMCIDQEDNELEVLEIIHHFVEILDRYFGSVCELDLIFNFHKAYYILDELVIAGELQESSKKTVARLIAAQDSLVEAAKEEASSLSNIIAQATK

SEQ ID NO: 3323 - protein, 161 aa, Pseudoroegneria spicata
MINFVLLISRQGKVRLTKWYSPYTQKERTKVIRELSGLILTRGPKLCNFVEWRGYKVVYRRYASLYFCMCTDADDNELEVLEIIHHFVEILDRYFGSVCELDLIFNFHKAYYVLDEILISGELQESSKKNVARLIAAQDSLVEAAKEEAGSISNIIAQATK

SEQ ID NO: 3324 - protein, 161 aa, Raphanus sativus
MIHFVLLVSRQGKVRLTKWYSPYTQKERSKVIRELSGVILNRGPKLCNFVEWRGYKVVYKRYASLYFCMCIDAEDNELEVLEIIHHYVEILDRYFGSVCELDLIFNFHKAYYILDELLIAGELQESSKKTVARIISAQDQMVEAAKEEAGSISNIIAQATK

SEQ ID NO: 3325 - protein, 161 aa, Raphanus sativus
MIHFVLLVSRQGKVRLTKWYSPYTQKERSKVIRELSGVILNRGPKLCNFIEWRGYKVVYKRYASLYFCMCIDETDNELEVLEIIHHYVEILDRYFGSVCELDLIFNFHKAYYILDELLIAGELQESSKKTVARIISAQDQLVEAAKEEASSISNIIAQATK

SEQ ID NO: 3326 - protein, 161 aa, Raphanus sativus; identical to SEQ ID NO: 3268

SEQ ID NO: 3327 - protein, 161 aa, Raphanus sativus; identical to SEQ ID NO: 3268

SEQ ID NO: 3328 - protein, 161 aa, Oryza sativa
MINFVLLISRQGKVRLTKWYSPYTQKERTKVIRELSGLILTRGPKLCNFVEWKGYKVVYRRYASLYFCMCIDAEDNELEVLEIIHHFVEVLDRYFGSVCELDLIFNFHKAYYILDEILIAGELQESSKKNVARLIAAQDSLVEAAKEEASSISNIIAQATK

SEQ ID NO: 3329 - protein, 161 aa, Secale cereale
  misc_feature (9)..(9): Xaa can be any naturally occurring amino acid
MINFVLLIXRQGKVRLTKWYSPYTQKERTKVIRELSGLILTRGPKLCNFVEWRGYKVVYRRYASLYFCMCIDADDNELEVLEIIHHFVEILDRYFGSVCELDLIFNFHKAYYVLDEILISGELQESSKKNVARLIAAQDSLVEAAKEEAGSISNIIAQATK

SEQ ID NO: 3330 - protein, 161 aa, Carthamus tinctorius
MIHFVLLISRQGKVRLTKWYSPYSQKERSKVIRELSGMILTRGPKLCNFVEWRGFKVVYKRYASLYFCMCINQEDNELEVLEIIHHYVEILDRYFGSVCELDLIFNFHKAYYILDEVLIAGELQESSKKTVARLVASQDSLVEAAKEEANSISNIIAQATK

SEQ ID NO: 3331 - protein, 161 aa, Solanum phureja; identical to SEQ ID NO: 3322

SEQ ID NO: 3332 - protein, 256 aa, Sorghum bicolor
MAKSASVQNFPTLSSLFPCLISFFFPQHGGGQVFISLHGLVQSLKDGSTSHGIILVASAASASRHLSYCGLEHDIKTARRTSFSCRNITLFLLWCQIHFVLLISRQGKVRLTKWYTPYPQKQRSKIIKEISTLVLTRGPKLCNFVDWQGYRVVYKRYASLYFCMCIDPADNELETLQIIHHYVEILDRYFGNVCELDLIFNFHKAYFILDEILIAGELQESNKKSVLRLVTTQDALVEAAKEEAGSLRNIIAQATK

SEQ ID NO: 3333 - protein, 161 aa, Sorghum bicolor; identical to SEQ ID NO: 3309

SEQ ID NO: 3334 - protein, 161 aa, Glycine max
MINFVLLISRQGKVRLTKWYSPYSQKERSKVIRELSGVILTRAPKLCNFVEWRGHKVVYKRYASLYFCMCIDEDDNELEVLEIIHHFVEILDRYFGSVCELDLIFNFHKAYYILDEILIAGELQESSKKTVARLIAAQDSLVENAKEEVSSLSNIIAQATK

SEQ ID NO: 3335 - protein, 161 aa, Glycine max
MINFVLLISRQGKVRLTKWYSPYSQKERSKVIRELSGMILSRAPKQCNFVEWRGHKVVYKRYASLYFCMCIDQDDNELEVLEMIHHFVEILDRYFGSVCELDLIFNFHKAYYILDEILIAGELQESSKKTVARLIAAQDSLVENAKEEASSFSNIIAQATK

SEQ ID NO: 3336 - protein, 161 aa, Picea glauca
MIHFVLLISRQGKVRLTKWYSPYSQKERSKIIREISGVILTRGPKLCNFIEWRGFKVVYKRYASLYFCMCIDAEDNELEVLEIIHHYVEILDRYFGSVCELDLIFNFHKAYYILDEILIAGELQESSKKTVARVIAAQDSLVESAKEQASSLSNIIAQATK

SEQ ID NO: 3337 - protein, 161 aa, Saccharum officinarum; identical to SEQ ID NO: 3309

SEQ ID NO: 3338 - protein, 161 aa, Saccharum officinarum; identical to SEQ ID NO: 3309

SEQ ID NO: 3339 - protein, 161 aa, Helianthus annuus
MIHFVLLISRQGKVRLTKWYSPYSQKERSKVIRELSGMILTRGPKLCNFVEWRGFKVVYKRYASLYFCMCINQDDNELEVLEIIHHYVEILDRYFGSVCELDLIFNFHKAYYILDEVLIAGELQESSKKTVARLVAAQDSLVEAAKEEAASISNIIAQATK

SEQ ID NO: 3340 - protein, 161 aa, Helianthus annuus
MIHFVLLISRQGKVRLTKWYSPYSQKERSKVIRELSGTILSRGPKLCNFVEWRGFKVVYKRYASLYFCMCINQEDNELEVLEIIHHYVEILDRYFGSVCELDLIFNFHKAYYILDEVLIAGELQESSKKTVARLVATQDSLVEAAKEEANSISNIIAQATK

SEQ ID NO: 3341 - protein, 161 aa, Helianthus annuus
MIHFVLLISRQGKVRLTKWYSPYSQKERSKVIRELSGMILTRGPKLCNFVEWRGFKVVYKRYASLYFCMCINQDDNELEVLEIIHHYVEILDRYFGSVCELDLIFNFHKAYYILDEVLIAGELQESSKKTVARLVASQDSLVEAAKEEAASISNIIAQATK

SEQ ID NO: 3342 - protein, 161 aa, Panicum virgatum; identical to SEQ ID NO: 3309

SEQ ID NO: 3343 - protein, 161 aa, Panicum virgatum
MINFVLLISRQGKVRLTKWYSPYTQKERTKVIRELSGLIITRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQVTK

SEQ ID NO: 3344 - protein, 161 aa, Panicum virgatum
MIHFVLLISRQGKVRLTKWYTPYPQKQRSKVIKEISSLVLTRGPKLCNFVDWQGYRVVYKRYASLYFCMCIDPADNELETLQIIHHYVEILDRYFGNVCELDLIFNFHKAYFILDEILIAGELQESNKKAVLRLVTTQDALVEAAKEEASSLSNIIAQATK

SEQ ID NO: 3345 - protein, 161 aa, Thellungiella halophila
  misc_feature (76)..(76): Xaa can be any naturally occurring amino acid
MIHFVLLVSRQGKVRLTKWYSPYTQKERSKVIRELSGVILNRGPKLCNFIEWRGYKVVYKRYASLYFCMCIDEADXELEVLEIIHHYVEILDRYFGSVCELDLIFNFHKAYYILDELLIAGELQESSKKTVARIISAQDQLVEAAKEEASSISNIIAQATK

SEQ ID NO: 3346 - protein, 161 aa, Nicotiana tabacum
MIHFVLLISRQGKVRLTKWYSPYTQKERTKVIRELSGMILTRGPKLCNFVEWRGYKVVYKRYASLYFCMCIDQEDNELEVLEIIHHYVEILDRYFGSVCELDLIFNFHKAYYILDELVIAGELQESSKKTVARLIAAQDSLVEAAKEEASSISNIIAQATK

SEQ ID NO: 3347 - protein, 161 aa, Solanum lycopersicum
MIHFVLLISRQGKVRLTKWYSPYSQKERTKVIRELSGMILTRGPKLCNFVEWRGYKVVYKRYASLYFCMCIDQEDNELEVLEIIHHFVEILDRYFGSVCELDLIFNFHKAYYILDELVIAGELQESSKKTVARLIAAQDSLVEAAKEEASSLSNIIAQATK

SEQ ID NO: 3348 - protein, 161 aa, Triphysaria pusilla
MIHFVLLISRQGKVRLTKWYSPYTQKERTKVLRELSGNILSRGPKLCNFVEWRGYKVVYKRYASLYFCMCIDQDDNELETLEIIHHFVEILDRYFGSVCELDLIFNFHKAYYILDEILIAGELQETSKKTVARLIAAQDSLVEAAKEQESSISNIIAQATK

SEQ ID NO: 3349 - protein, 161 aa, Juglans hindsii x Juglans regia
  misc_feature (112)..(112): Xaa can be any naturally occurring amino acid
MIHFVLLISRQGKVRLTKWYSPYSQKERTKVIRELSGVILTRGPKLCNFVEWKGYKVVYKRYASLYFCMCIDQEDNELEVLEIIHHYVEILDRYFGSVCELDLIFNFHKAYXILDELLIAGELQEPSKKTVARLISAQDSLVETAKEQRSSISNIIAQATK

SEQ ID NO: 3350 - protein, 161 aa, Juglans hindsii x Juglans regia
MIHFVLLISRQGKVRLTKWYSPYTQKERTKVLRELSGVILTRGPKLCNFVEWRGYEVVYKRYASLYFCMCIDHEDDELEILEIIHHYVEILDRYFGSVCELDLIFNFHKAYYILDELLIAGELQESSKKTVARLIAAQDSLVEAAKEQRSSISNIIAQATK

SEQ ID NO: 3351 - protein, 161 aa, Triticum aestivum; identical to SEQ ID NO: 3274

SEQ ID NO: 3352 - protein, 161 aa, Triticum aestivum; identical to SEQ ID NO: 3274

SEQ ID NO: 3353 - protein, 161 aa, Triticum aestivum; identical to SEQ ID NO: 3274

SEQ ID NO: 3354 - protein, 328 aa, Brachypodium distachyon
MARGIARAASFGGRATAGWFSYRRVTVAVCLGNLVAALLVLRSLTSSAPAPKRVEVVQYTEEQIRRVEESIRIRREAEPIELVQAVKKLRKVFAREEKRRKKLPLELKQKVSYEIVWQLHELGDNSSVIQQREVLESWRVETLKDIKSASTQNSSNLGFSNEEARILKRALEFNWHMLLEDIGLWIPLEISHTEHDDKPDNEPEEEEIIAGPPLDPQCNAELHADYGGAAVKWGLTHHKESAADCCQACLDQAKNAKPGEMKCNIWVYCPSEFGCYSPDKYEHKHQECWLKQADQPKLNFKDRYSESYRDSHPRAPVVVPWMSGVTSA

SEQ ID NO: 3355 - protein, 330 aa, Zea mays
MARGVARAVSFGRRATTGWCSYRRVTVAVCIGNLVAVLLVLRSLTAPASFAPTAPNRGEVVQYTEEQIRWVEESIRIRREAEPVELVLAVKKLRKKLAQEVKRREELSLVLKQKVYYDIARGLHELGDNSSLAQQREVVESWRVEKLKNSASTRNQSSLDLSSEETRMLKQALEFNWHMLLEDIGLWIPDEVTHTVHDDKPENEPEEEEIVAGPPLSPQCNAELHTDYDGAAVRWGLTHHKESAADCCQACLDQAKNAKPGELKCNIWVYCPSEFGCFSPDKYEHKHQECWLKQADHPKLNFKDKYSEPYRDAHPTAPVVVPWMSGVIGA

SEQ ID NO: 3356 - protein, 333 aa, Sorghum bicolor
MARGIARAVSFGGRATTGWCSYRRVTVAVCLGNLVAALLVLRSLTAPASFAPTAPNRVEVVQYTEEQIRSVEESIRIRREAEPVELVLAVKKLRKKFAQEEKRRREELPLVLKQKVSYDIVRRLHDLGDNGSLAEQREVVESWRVEKLKDIKVASTRNQSNLDLSSKETRMLKRALEFNWYMLMEDIGLWIPEEVKHTVHDDKPENEPEEEEIVAGPPLSPQCNAELHTDYDGAAVRWGLTHHKESAADCCQACLDQAKNAKPGELKCNIWVYCPSEFGCFSPDKYEHKHQECWLKQADHPKLNFKDKYSEPYRDAHPNAPVVVPWMSGVTSA

SEQ ID NO: 3357 - protein, 331 aa, Panicum virgatum
MARGIARAVSFGGRSTAGWCSYRRVTVAVCLGNLVAALLVLRSLTAPASFAPTPLNPDVVQYTEEQIKRVEESIRIRHEAEPVELVRAVKRLQKVFTREEKRRKELPLELKQKISYDIVQRLQDLGDNGSLAQQREAVESWHAEKLKDLKSASTQNQTNLDLSSEETRMLKRALEFNWHMLMEDIGLWIPEEVTHTLHDDKPENEPEEEEIIAGPPLSPQCNAELHTDYDGAAVRWGLTHHKESAADCCQACLDQAKNAKPGELKCNIWVYCPSEFGCYSPDKYEHKHQECWLKQANHPKLNFKDKYSESYRDAHPTAPVVVPWMSGVISA

SEQ ID NO: 3358 - protein, 762 aa, Oryza sativa
MTMLPATAAALLVLVLQLMWSAEAQVAVGSGPPAGCPDRCGNVSVPFPFGIRDGCSLEGFGLTCNTTSNPPRLMIGNSTLQVVNISLANSTLRAVDIDGAVNITYGQIDGNGTWVGVVASPYIVNETLNQLLVTGCNIQVTLVGSGGNVISGCSSFCSINDMYTGGVFRSPGNKCAGIGCCQQQVSIGRPSYRVELTNLDRDREFSGRVPEAVRIAELGWFDGLAADLLNVSLADTSRRNPVPVVLDWAVASTGLDVTLNAGLNKQAANNWSCPTAASGRKSACISSNSFCRNIADNYRSGYVCRCDKGYDGNPYVAGGCQDINECERAKENGCFGECTNTPGAFLCRCPHGARGNATIPNGCTKSNLGLTIGVGIGSGAGLFILALGAVFLTRRIKQRRARTLRQKFFKQNRGHLLQQLVSQKADIAERMIIPLAELEKATNNFDESRELGGGGHGTVYKGILSNLHVVAIKKSNVTVQREIDEFINETEVPLLVYEFISNGTLYHHLHVEGPTSLPWEDRLRIATETARSLTYLHSAVSFPIIHRDIKSHNILLDGSLTAKVSDFGASRCIPTEQNGVTTAIQGTLGYLDPIYYYTGRLTDKSDIYSFGVVLMELLTRKKPYSYRSAEDESLVAHFSTLHAQGNLGDILDAQVIEEGTKEVNDVATLAVACAKLKAEERPTMRQVEMTLESIRQEVLHSVSTKKSKELHVSWNHAISEGSIFYQAVDTSIVIVSDVGSSDNLCDGAVIGRNRFPGTQCRQ

SEQ ID NO: 3359 - protein, 360 aa, Zea mays
MLSSSTSTLRLHQPTRPHRRHPPAPALGVATHLASPRRWRGHAPGAGAPLRARPQRIRAVDAAQPFDYESRAAGLLEERQRLKIAIVGFGNFGQFLARTFARQGHTLLAHSRTDHTALATTLGATFFADPHDLCECHPDVVLLATSILSAEAVLRSLPVHRLRRNTLFVDVLSVKEFPKNLLLSSLPPDFDVICTHPMFGPESARDGWDGLPFVFDRVRVGDCPARRARADAFLNIFEREGCRMVEMSCAEHDAHAAETQFLTHTVGRMLAMLELRSTPINTKGYETLLRLVDNTCSDSFDLYNGLFMYNKNSTELLNRLEWAMDSVKKRFFDGLHDVLRKQLFEGSPHAPDVSSSNVRK

SEQ ID NO: 3360 - protein, 373 aa, Brachypodium distachyon
MAKEGAGGGPDWNGLLKWSLAHGDGTNPPRALSEEDRKWFMEAMQANTIDVVSRMKEITQVMKTPDDVLQSHGVTPENIEDMLDELQEHVESIDMANDLHSIGGLDPLLGYLKNSHAGIRAKAAEVVSTIVQNNPKSQQLVMESNGLEPLLTNFKSDPSTTARTKALGAISSLVRNNQPGLAAFCLGNGYAALKDALGSDDARLQRKALHLMQYLLDNKADRSVATELGLPNLMMHLASSDDAGVREAALGGLLQLARDKTPAAGNTLPDQDKLKDVLRSRIEGISSMDADDLHAAREERQLVDSLWKECYNEPSSLREKGLVVLPGEDAPQQPPPDVAGKMFEPPLRAFAAVSSEGSDSGSGKKDPPLLLGP

SEQ ID NO: 3361 - protein, 381 aa, Cenchrus ciliaris
MAKDGGPDWNGLLKWSLAHGDGTNPPRALSEEDRKWFMEAMQANTIDVVKRMKEITQVMKTPEDVLESQGVTPENIEDMLDELQEHVESIDMANDLHSIGGLDPLLGYLKNSHAGIRAKAAEVVSTIVQNNPKSQQLVMESNGLEPLLTNFKSDPSTSARTKALGAISSLIRHNQPGISAFRLGNGYAGLKDALGSDDARLQRKALNLTQYLLHNNKADRSIATELGLPKLMMHLASSDDSLVREAALSGLLELAQDKTSGNTLPDQDKLKDILKSRIEGISTMDTDELHAAREERQLVDSLWKECYNEPSSLREKGLVVLPGEDAPQQPPPDVAGKMFEPPLRAWAAARPAPKDDFDNGSEKKDAPPLLLGPGPPSNSNF

SEQ ID NO: 3362 - protein, 375 aa, Leymus cinereus x Leymus triticoides
  misc_feature (223)..(223): Xaa can be any naturally occurring amino acid
  misc_feature (338)..(338): Xaa can be any naturally occurring amino acid
  misc_feature (346)..(346): Xaa can be any naturally occurring amino acid
MAKDGAGGGPDWNGLLKWSLAHGGDGTNPPRALSEEDRKWFMEAMQANTIDVVGRMKEIAQVMKTPDDVLQSHGVTPENIEDMLDELQEHVESIDMANDLHSIGGLDPLLGYLKNSHAGIRAKAAEVVSTVVQNNPKSQQLVMESNGLEPLLTNFRSDPSTTARTKALGAISSLIRNNQPGLAAFRLGNGYAALKDALGSDDARLQRKALHLTQYLLNNKADXSVAAEIGLPNQLIHLASSDDSGVREAALGGLLELARDKTPAAHNALPDQNKLKDVLRSRIEGISAMDADDLQAAREERQLVDSLWKECYGEPSSLREKGLVVLPGEDAPQHPDVXGKMFEPPXRAWAAPRPAPAEDSDSGSGKKDPPLLLGP

SEQ ID NO: 3363 - protein, 372 aa, Zea mays
MAKDGGPDWNGLLKWSLAHGDGTNPPRALSEEDRKWFMDAMQANTVDVVKRMKEITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGVSAFRLGNGYAGLKDALGSDDARLQRKALNLIQYLLHNYKADRSVATELGLPKLMMHLVSSDDSLVREAALGGLLELARDKTSGNALPDQEKLKDMLKSRIEGISAMDTDDLHAAREERQLVDSLWKECYNEPSSLREKGLVVLPGEDAPQQPPPDVAGKMFEPPLRAWAAARPAQEDDSDSGSGKKDPPLLLKF

SEQ ID NO: 3364 - protein, 379 aa, Oryza sativa
MAKDGGGPDWNGLLKWSLAHGDGTAKPRSLSEEDKKWFMEAMQANTMDVVKRMKEITQVMKTPDDVLQSQGVTPENIEDMLDELQEHVESIDMANDLHSIGGLDPLLGYLKNSHAGIRAKAAEVVSTIVQNNPKSQQLVMESNGLEPLLTNFSSDASTNSRTKALGAISSLIRHNQPGVAAFRLGNGYSALRDALGSDDARLQRKALHLLQYLLHDNKADRSVATELGLPKLMMHLASSDDSGVREAALGGLLELARDNTSGAGNVLPDQDKLKDVLKSRIEGISTMDADDLSAHREERQLVDSLWKECYNEPSSLREKGLVVLPGEDAPQQPPPDVVGSMFEPPLRAWAASRPPPKEDSESESAKKDPPLLLGPGPSS

SEQ ID NO: 3365 - protein, 372 aa, Sorghum bicolor
MAKDGGPDWNGLFKWSIAHGDGTKPPRALSEEDRKWFMEAMQANTIDVVKRMKEITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGISAFRLGNGYAGLKDALGSDDARLQRKALNLIQYLLHNNKADRSVATELGLPKLMMHLASSDDSLVREAALSGLLELAQDKTSGNVLPDQDKLKDILKSRIEGISVMDSDDLHAAREERQLVDSLWKECYNEPSSLREKGLVVLPGEDAPQQLPPDVAGKMFEPPLRAWAAARPAQEDDSDSGSGKKDPPLMLKF

SEQ ID NO: 3366 - protein, 372 aa, Saccharum officinarum
  misc_feature (54)..(54): Xaa can be any naturally occurring amino acid
  misc_feature (219)..(219): Xaa can be any naturally occurring amino acid
MAKDGAPDWNGLFKWSIAHGDGTKPPRALSEEDRKWFMEAMQANTIDVVKRMKXITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGISAFRLGNGYAGLKDALGSDDARLQRKALNLIQYLLHNNKAXRSVATELGLPKLMMHLASSDDSLVREAALSGLLELAQDKTAGNALPDQDKLKDILKSRIDGISAMDSEDLHAAREERQLVDSLWKECYNEPSSLREKGLVVLPGEDAPQQLPPDVAGKMFEPPLRAWAAAKPAQEEGSDSGSGKKDPPLMLKF

SEQ ID NO: 3367 - protein, 380 aa, Panicum virgatum
MAKDGGPDWNGLLKWSLAHGDGTNPPRALSEEDRKWFMEAMQANTIDVVQRMKEITQVMKTPEDVLESQGVTPENIEDMLDELQEHVESIDMANDLHSIGGLDPLLGYLKNSHAVIRAKAAEVVSTIVQNNPKSQQLVMESNGLQPLLTNFKSDPSTNARTKALGAISSLIRHNQPGISAFRLGNGYAGLKDALGSDDARLQRKALNLIQYLLHNNKADRSVATDLGLPKLMMHLASSDDSLVREAALSGLLELAQDKTSGNALPDQDKLKDILKSRIEGISLMDADDLHVAREERQLVDSLWKECYNEPSSLREKGLVVLPGEDAPQQPPPDVVGKMFEPPLRAWAAARPAPKDDSDSGSEKKDAPPLLLGPGPSSNNS

SEQ ID NO: 3368 - protein, 220 aa, Triticum aestivum
MAKEGAGGGPDWNGLLKWSLAHGSDGTNPPRALSEEDRKWFMEAMQANTVDVVGRMKEIAQVMKTPDDVLQSHGVTPENIEDMLDELQEHVESIDMANDLHSIGGLDPLLGYLKNSHAGIRAKAAEVVSTVVQNNPKSQQLVMESNGLEPLLTNFRSDPSTTARTKALGAISSLIRNNQSGLAAFRLGNGHAALKDALGSDDARLQSSASHTVPAEQQGG

SEQ ID NO: 3369 - protein, 377 aa, Triticum aestivum
MAKDGAGGGPDWNGLLKWSLAHGSDGTNPPRALSEEDRKWFMEAMQANTVDVVGRMKEIAQVMKTPDDVLQSHGVTPENIEDMLDELQEHVESIDMANDLHSIGGLDPLLGYLKNSNAGIRAKAAEVVSTVVQNNPKSQQLVMESNGLEPLLTNFRSDPSTTARTKALGAISSLIRNNQSGLAAFRLGNGHAALKDALGSDDARLQRKALHLTQYLLNNKADRNVAAEIGLPNQLIHLASSDDSGVREAALGGLLELARDKTPAASNALPDQDKLKDVLKSRIEGISAMDADDLQAAREERQLVDSLWKECYGEPSSLREKGLVVLPGEDAPQQPPPDVAGKMFEPPLRSWAAPRPAPAEDSDSGSGKKDPPLLLGP

SEQ ID NO: 3370 - protein, 472 aa, Oryza sativa
MTTKTFVLFPSLGVGHLNPMVELAKHLRRRGLGVIVAVIDPPNNDAMSADAMARLAAGNPSVTFRILPAPASPDPGAHHVKRNLDTLRLANPVLREFLRSLPAVDALLLDMFCVDALDVAAELAIPAYFFFPSPASVLAVFSHLPYYYRNAPSLREMDKAALIRFPGIPPIRNVDMLATVKDKESETTKIRLYQFKRMMEGKGVLVNSFDWLEPKALKALAAGVCVPNEPKQRVYFIGPLVDARKKVGSGAERHACLAWLDAQPQRSVVFLCFGSQGAFPAAQLKELAHGLESSGHRFLWTVRSPPEEQSTSPEPDLERLLPAGFLERTKGRGMVVKNWVPQAEVVQHEAVGAFVTHCGWNSTLEAIMSALPMICWPLYAEQAMNKVIMVEEMKIAVSLDGYEEGGLVKAEEVEAKVRLVMEAEEGRKLRERLVETRDMALDAIKEAGSSEVAFDEFMRDLEKSSLENGVRS

SEQ ID NO: 3371 - protein, 240 aa, Oryza sativa
MKRKTFVLFPSLGVGHLNPMVELAKHLHRQGLGVVVAVIDPRDDDATSADATARLAAANPSVTFRILPAPATASPDPGPHRVRRSLDTLRLANPVLLEFLRSLPAAVDALLLDMFCVDALDVAAELAIPAYFFFPSPASALAVFLHLPHYYANGTSFREMGQGERDDQDQVVPVQADDGREGRAGEQLRLAGAQGPESARRRCLRARQAHAERLLRRATGRHRQQGRERRREAPCVPRVA

SEQ ID NO: 3372 - protein, 517 aa, Sorghum bicolor
MVSGQKGTDFSVPLVVVTPLSLCSRGRGVRAPRERGGRERRRRGGVMKSMPPPLPHLCSSAFVVLLLLLCRPLVANGRATPTGASPPSPEGPSAAQPALQPAPAANGAAAVLPAAAGPPPLGVIVVERHHHLRRELIAAIILSSVAIVVITIAALYAFLLWRRSRRALVDSKDTQSIDTARIAFVPMLNSFNSYKTTKKSAAAMMDYTSLEAATEKFSESNVLGVGGFGSVYKANFDGRFAAAVKRLDGGAGAHDCEKEFENELDLLGRIRHPNIVSLVGFCIHEENRFIVYELMENGSLDSQLHGPSHGSALSWHIRMKIALDTARGLEYLHEHCNPPIIHRDLKSSNILLDSDFSAKISDFGLAVISGNHSKGNLKLSGTMGYVAPEYLLDGKLTEKSDVYAFGVVLLELLLGRKPVEKTAQSQCQSIVTWAMPQLTDRSKLPNIIDPMIKNTMDLKHLYQVAAVAVLCVQPEPSYRPLITDVLHSLVPLVPMELGGTLRISPESPYATQMQSPI

SEQ ID NO: 3373 - protein, 528 aa, Sorghum bicolor
VDHAPRTGRVSATAAMADATPSIPSAIASLQAYSTALSAFTAAWRAVETHASSLDSTLAARLAGYTELELICSAMDGAGLLAYLTEHRDELKEPARALDAALQVAPDPGLLVLSAAATFCRTPPEKAKNDGSVKASCRLLMALLDRLRAIGFKPSPEARDEARAVAADWKRGKRIGTEVMFKQETFAFLHLVGVFGLVEDVGGAGEVLDLVVSISGRERAVEAFLVLGLDLDQHMPILIQKMVNKSKQLEAVKFIQALNIVHKYPLLPIMRSYIDHAAVAGKMIRIRGDDLATQNAADAKERTLLGTLQKFIKEQKLEELPIFEEANKRMAHLDQQSAERKRTAAAAAAAAQKVSKNIEEQQKKIQELMQPAKRPRPENVVQGSLGQNVNPARTSTQQFKPQHSIHKAGVSNQYQAALTQNVLPAINQISQLVAGSHRPVGIQNQAIAVPPQYGSGSLASYYGVTSTTPYRSSTLAPGPGALNGPSAQASSRSKLYSGDPLAAVSRSSDKKGSSYKYSLSSMSTYDHK

SEQ ID NO: 3374 - protein, 307 aa, Saccharum officinarum
MAIISDFKEDEAPQQAAAAGPGVEESLVAALERSGGALPFLQAAIDVAHRRSGLFRDPSAVSKVTAMAAAVRAQVEAEERAAREAKRKAEEAERKAAAEAQKAAAEAAATATAEEKPESSVEKDSMEVDKKEEGNVRQPNAGNGLDLEKYLWTQQLPEVNITIPVPQGTKSRFVVFDIKKNHLKVGLKGQPPIIDGELYKPVKVDDCFWSIEDGKTLSILLTKHNQMEWWKSVIKGDPEVDTQKVEPESSKLSDLDPETRQTVEKMMFDQRQKQMGLPTSDEMQKQEILKKFMSEHPEMDFSRAKLA

SEQ ID NO: 3375 - protein, 236 aa, Sorghum bicolor
MDFEYVPASPGSSRWAGESAARRRQRRLSSPSLRTYLTPAFDAVAGGDGGVSGYTSSSSSGGLELGFDASLLRYRRSCFAASADLDSRVLLYSPQSAPPPPQMRAGYLVADDGVWAPGGGHYGSKHEAGRLTGAPGFQDSENRISFVSAPQTSSNLPTTVLGASTLAKLPAELQLPEGSIVATNAELPTPGPDATPSALKSSADPEPSVEGDEIIEALYGDSGRRRLPIFREICPE

SEQ ID NO: 3376 - protein, 258 aa, Hordeum vulgare
MVPWEGYASDETMGTFAPILLYWVYAGGYQLVLHRRPLQRYRLHTRAEEEDKNLVTLPAVVRGVLLQQLVQAIVGMILFMITSDSSTVLVQPSMVVQSFQFLVAMLVMDTWQYFVHRYMHQNKFLYRHIHSQHHRLIVPYAIGALYNHPLEGLLLDTLGGAMSFLVSGMTPRTAVFFFCFAVLKTVDDHCGLWLPYNIFQHLFQNNTAYHDIHHQLQGTKYNYSQPFFSIWDRILGTHMAYDLVSRKEGGLEARPLRD

SEQ ID NO: 3377 - protein, 258 aa, Brachypodium distachyon
MVPWEGYVSDETMGTFAPIVLYWVYAGGYQLVLHRRPLERYRLHTLAEEDEKNLVTLPAVVRGVLLQQLVQAIVAMFLFMITSDSSTVIVQPSMVVQMFQFLVAMLVMDTWQYFVHRYMHQNKFLYRHIHSQHHRLIVPYAIGALYNHPLEGLLLDTLGGAMSFLVSGMTPRTAVFFFCFAVLKTVDDHCGLWLPYNIFQRLFQNNTAYHDIHHQLQGTKYNYSQPFFSIWDKILGTHMAYSLVSRKEGGFEARASRD

SEQ ID NO: 3378 - protein, 258 aa, Oryza sativa
MVPWEGYVSDETMGTFAPIALYWVYAGGYQLVLHRRPLERYRLHTRAEEEEKNLVALPAVVRGVLLQQLVQAIVAMILFMVTSDSSAVVVQPPIIIQAFQFLVAMLVMDSWQYFVHRYMHQNKFLYRHIHSQHHRLIVPYAIGALYNHPLEGLLLDTVGGAISFLVSGMTPRTSVFFFCFAVLKTVDDHCGLWLPYNIFQSLFQNNTAYHDVHHQLQGSKYNYSQPFFSIWDRILGTHMPYNLVRRKEGGFEARPLRD

SEQ ID NO: 3379 - protein, 258 aa, Sorghum bicolor
MVPWEGYISDETMGTFAPIVLYWVYAGGYQLILHRRPLERYRLHTRAEEEEKNLVSLPTVVRGVLLQQLVQAIVAMILFMVTSDSSITVVQPPIVVQIFQFLIAMLVMDSWQYFVHRYMHQNKFLYRHIHSQHHRLIVPYAIGALYNHPLEGLLLDTLGGAISFLVSGMTPRTAVFFFCFAVLKTVDDHCGLWLPYNIFQHLFQNNTAYHDIHHQLQGTKYNYSQPFFSIWDRILGTHMPYDLVSRKEGGFEARPLRD

SEQ ID NO: 3380 - protein, 75 aa, Saccharum officinarum
  misc_feature (29)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (42)..(42): Xaa can be any naturally occurring amino acid
  misc_feature (48)..(49): Xaa can be any naturally occurring amino acid
  misc_feature (51)..(52): Xaa can be any naturally occurring amino acid
  misc_feature (54)..(55): Xaa can be any naturally occurring amino acid
  misc_feature (57)..(57): Xaa can be any naturally occurring amino acid
  misc_feature (59)..(59): Xaa can be any naturally occurring amino acid
MVPWEGYISDETMGTFAPIVLYWVYAGGXQLXLXRRRLSGTXSTRGPXXRXXTXXAXPXSSAAYSCSSSCRPSSR

SEQ ID NO: 3381 - protein, 257 aa, Panicum virgatum
MVPWEGYLSDETMGTFAPIVLYWVYAGGYQLILHRRPLERYRLHTRAEEEKNLVSLPAVVRGVLLQQLVQAIVAMILFMVTSDSSVTVVQPPIVVQIFQFLIAMLVMDSWQYFVHRYMHQNKFLYRHIHSQHHRLIVPYAIGALYNHPLEGLLLDTLGGAISFLVSGMTPRTAVFFFCFAVLKTVDDHCGLWLPHNIFQNLFQNNTAYHDIHHQLQGTKYNYSQPFFSIWDRILGTHMPYNLVSRKEGGFEARPLRD

SEQ ID NO: 3382 - protein, 258 aa, Triticum aestivum
MVPWEGYVSDETMGTFAPILLYWVYAGGYQLVLHRRPLQRYRLHTRAEEEDKNLVTLPAVVRGVLLQQLVQAIVAMILFMITSDSSVVLVQPSMVVQSFQFLVAMLVMDTWQYFVHRYMHQNKFLYRHIHSQHHRLIVPYAIGALYNHPLEGLLLDTLGGAMSFLVSGMTPRTAVFFFCFAVLKTVDDHCGLWLPYNIFQHLFQNNTAYHDIHHQLQGTKYNYSQPFFSIWDRMLGTHMAYDLVSRKEGGFEARPLRD

SEQ ID NO: 3383 - protein, 291 aa, Brachypodium distachyon
MAGGGSPSDAEAELRQGFKTLAVTRPDPSAAVYEVRLNRPAQRNALSPDSFAEIPRAMALLDRLPAARAVVLSASGPHFCAGIELGGPGNPLTASFSRGADPVAAAEGLRRAILDMQAAMTAVELCRKPVIAAVHGACVGGGVDLVAACDVRYCSKDATFVLKEVDMAIVADLGALQRLPRIVGYGNAAELALTGRRITAVEAKEMGLVSRVFDSKQEMDAAVAKIAKDISEKSAWAVMGTKAVLLRSRDITIEQGLEHVATWNAGMMRSSDLMEAIKAFLEKRKPVFSKL

SEQ ID NO: 3384 - protein, 288 aa, Zea mays
MAGGGDRDASDAELRAGFETLAVTRPDPSAGVYEVRLNRPAQRNALSPAAFAEIPRAMSLLDRAPSARAVVLSAAGPHFCAGIELGGPGDPLSAASADPVAAAEGLRRAVLDMQAALTAIERCRKPVVAAVHGACVGGGVDLVAACDIRCCSRDASFVLKEVDMAIVADLGALQRLPRIVGYGNAADLALTGRKINAMEAKDMGLVTRVFDSKQDLDAGVAKIAKEIADKSAWAVIGTKAVLLRSRDATIEQGLEHVATWNAGMMRSNDLKEAIRAFLEKRKPVFSKL

SEQ ID NO: 3385 - protein, 294 aa, Sorghum bicolor
MAGGNRDASDAAAAEAELRAGFETLAVTRPDPSAGVYEVRLNRPAQRNALSPAAFAEIPRAMSLLDRTPTARAVVLSAAGPHFCAGIELGGPGNPLAAASSSADPVDAAKALRRAVLDMQAALTAIERCRKPVVAAVHGACVGGGVDVVAACDIRCCSRDATFVLKEVDMAIVADLGALQRLPRIVGYGNAADLALTGRKITAMEAKEMGLVTRVFDSKKELDAGVANIAKEIAEKSAWAVMGTKAVLLRSRDVTVEQGLEHVATWNAGMMRSNDLKEAIKAFLEKRKPVFSKL

SEQ ID NO: 3386 - protein, 290 aa, Triticum aestivum
  misc_feature (29)..(29): Xaa can be any naturally occurring amino acid
  misc_feature (102)..(102): Xaa can be any naturally occurring amino acid
  misc_feature (152)..(152): Xaa can be any naturally occurring amino acid
  misc_feature (155)..(155): Xaa can be any naturally occurring amino acid
MAGAGSSDAEAELRRGFKALAVTRPDPAXAVYEVRLSRPAQLNALSPDSFAEIPRAMALLDRIPAARAVVLSAAGPHFCAGIELGGPGNPLTAPPARGADPXAMAEGLRRAILGMQAALTAVELCRKPVIAAVHGACVGGGVELVAACDIRXCSXDATFVLKEVDMAIVADLGALQRLPRIVGYGNAADLALTGRRITAAEAKEMGLVSRVFDSKQELDAGVAKIAKEISEKSANAVMGTKAVLLRSRDITVEQGLEHVATWNSGMLRSNDLMEAIKAFMEKRKPVFSKL

SEQ ID NO: 3387 - protein, 141 aa, Oryza sativa; identical to SEQ ID NO: 426

SEQ ID NO: 3388 - protein, 84 aa, Zea mays
MAKYLAVALLLLVVLAYCDGRELNQKDQALATARGAGAGAGGGVGEEKILGLAELPLVGTVTGTSTVTGPVVVVPALPGIPAHP

SEQ ID NO: 3389 - protein, 95 aa, Secale cereale
HNTISSVHQSLPVSNMAKCLAAALLLLVVLAYCDGRELNQKDQALATARGAGGGVGEEKILGLPELPLVGTVTGTSTVTGPVVVLPALPALPAHP

SEQ ID NO: 3390 - protein, 86 aa, Triticum aestivum
MAKCLAAALLLLVVLAYCDGRELNQKDQALATARGAGAGAGAGGGVGEEKVLGLPELPLVGTVTGTSTVTGPVVVVPALPGIPAHP

SEQ ID NO: 3391 - protein, 83 aa, Triticum aestivum
MAKCLAVALLLLVVLAYCDGRELNQKDQALATARGAGAAGGGVGEEKVLGLPELPLVGAVTGTSTVTGPVVVVPALPGIPAHP

SEQ ID NO: 3392 - protein, 112 aa, Triticum aestivum
TATQHYHSNTAAQARLTSSVVYRSLPASNMAKCIAVALLLLVALAYCDGRELNQKDQALATARGAGAAGGGVGEEKILGLPDLPPVGTVTGTSTTNGPLVALPAIPGIPAHP

SEQ ID NO: 3393 - protein, 105 aa, Triticum aestivum
HASETQPHNTISSVHQSLPVSNMAKYLAVALLLLVVLAYCDGRELNQKDQALATARGAGAAGGGVREEKVLGLPELPLVGTVTGTSTVTGPVVVVPALPGIPAHP

SEQ ID NO: 3394 - protein, 83 aa, Triticum aestivum
MAKCLAVALLLLLVLAYCDGRELNQKDQALATARGAGAAGGGVGEEKILGLPDLPPVGTVTGTSTTNGPLVALPALPGIPAHP

SEQ ID NO: 3395 - protein, 105 aa, Triticum aestivum
PRVRQPHNTISSVHQSLPVSNMAKYLAVALLLLVVLAYCDGRELNQKDQALATARGAGAGAGGGVGEEKILGLAELPLVGTVTGTSTVTGPVVVVPALPGIPAHP

SEQ ID NO: 3396 - protein, 79 aa, Triticum aestivum
MAKCLAVALLLLVALAYCDGRELNQKDQALATARGAGAGGAVDESKALGLPDLPLVGTVTGTSTITGPLVVLPGIPAHP

SEQ ID NO: 3397 - protein, 599 aa, Hordeum vulgare
MKYVLVTGGVVSGLGKGVTASSIGVLLKACGLRVTSIKIDPYLNTDAGTMSPFEHGEVFVLEDGGEVDLDLGNYERFLDIKLTRDNNITTGKIYQAVINKERKGDYLGKTVQVVPHITDEIQDWIERVAMNPVDGTDKPADVCVIELGGTIGDIESMPFIEALGQFSYRVGPGNFCLVHVSLVPVLTVVGEQKTKPTQHSVRGLRGLGLMPDILACRSTQPLEENVKLKLSQFCQVPVSNIVNLHDVTNIWHIPLLLRDQRAHEAILKVLGLWCVGKVPKEPKLSEWTERASRFDKLKSPVRIAMVGKYTGISDSYLSILKALLHASVALDRKLVVDWVPSCDLEDSAAEETPEAYKKAWGLLKGANGVLVPGGFGDRGVQGKILAAKHARENNVPYLGICLGMQIAVIEYARSVMKLRDANSTEFDPAAKTPCVIFMPEGSKTHMGATMRLGSRRTFFQVNNCKSAKLYANANYVDERHRHRYEVNPDMVSDFEKAGLSFVGRDESGRRMEIIELPAHKFFVGTQFHPEFNSRPGKPSPLFLGLIAASSGQLEPLLQPTSGAVTSPTRCIAGPGAPKAKFKMNGLKSTYYANGSSIHI

SEQ ID NO: 3398 - protein, 610 aa, Brachypodium distachyon
MKYVVVTGGVVSGLGKGVTASSIGAVLKSCGLRVTTIKIDPYLNTDAGTMSPIEHGEVFVLDDGGEVDLDLGNYERFLDIKLTGDNNITTGKIYQAVIDKERRGDYLGKTVQVVPHITDEIQDWIERVAMNPVDGKEGPPDVCVIELGGTIGDIESMPFIEALGQFSYRVGTGNFCLVHVSLVPVLTVVGEQKTKPTQHSVRGLRGLGLAPDILACRSTEPLEEHVTAKLSQFCNVPISSIVNLHDVTNIWHIPLLLRDQKAHEAILKVLDLQLLGKVPREPKLAEWTERASKLDKLKTPVTIAVVGKYTGLSDSYLSIQKALLHASVVMERKLVVEWIPSCDLEDSAAKDTHEAYQKAWKLLKGADGVLVPGGFGDRGVQGKILAAKYARENNVPYLGICLGMQIAVIEFARSVMKLCSANSTEFDPATTSPCVIFMPEGSRTQMGATMRLGSRRTYFLGNNCKSGKLYGNASFVDERHRHRYEVNPEIVPELEKAGLSFVGKDESGSRMEIVELPSHDFFIGVQFHPEFKSRPGKPSPLFLGLIAAASGQLDLLLQRSSGVVSSNLAPRCITKGTTVPVIKVYPNGHIKKPLKSLVNGYYTNSNGIHI

SEQ ID NO: 3399 - protein, 599 aa, Brachypodium distachyon
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQAVIDRERRGDYLGKTVQVVPHITDAIQEWIERVALNPVDGTEEPADVCVIELGGTIGDIESMPFIEALGQFSYRVGHGNFCLVHVSLVPVLNVVGEQKTKPTQHSVRGLRGLGLMPDILACRSTQPLEENVKLKLSQFCQVPISNIVNLHDVTNIWHIPLLLRDQKAHEAILNVLGLWCVGRVPQEPKLAEWTERASKFDKLKTPVRIAMVGKYTGISDSYLSVLKALLHASVALDRKLVVDWVPSCDLEDSTAKETPDAYEKAWVLLKGAHGILVPGGFGDRGVQGKILAAKYARENKVPYLGICLGMQIAVIEYARSVMKLHGANSTEFDPAAKTPCVIFMPEGSTTHMGATMRLGSRRTFFQVNNCKSAKLYSNASYVDERHRHRYEVNPDMVPEFEKAGLSFVGRDESGRRMEIIELPNHRFFVGTQFHPEFNSRPGKPSPLFLGLIAAASGQLDHLLQRTGGAVRCITGTGTGKPKLFKKKPFNGLVTTYYANGSSIHI

SEQ ID NO: 3400 - protein, 242 aa, Festuca arundinacea
  misc_feature (137)..(137): Xaa can be any naturally occurring amino acid
  misc_feature (145)..(146): Xaa can be any naturally occurring amino acid
  misc_feature (169)..(169): Xaa can be any naturally occurring amino acid
MKYVLVTGGVVSGLGKGVTASSIGVLLKACGLRITSIKIDPYLNTDAGTMSPFEHGEVFVLDDGGEVDLDLGNYERFLDIKLTRDNNITTGKIYQAVIDKERRGDYLGKTVQVVPHITNEIQEWIERVAMNPVDGTXKPADVCVXXLGGTIGDIESMPFIEALGQFSYXVGAGNFCLVHVSLVPVLNVVGEQKTKPTQHSVRGLRGLGLMPDILACRSTEPLGKKCETETLAVLPSSGFKYC

SEQ ID NO: 3401 - protein, 605 aa, Zea mays
MKYVLVTGGVVSGLGKGVTASSVGVVLKSCGLRVTSIKIDPYLNIDAGTMSPLEHGEVFVLDDGGEVDLDLGNYERFLDIKLTRDNNITTGKIYQSVIDKERRGDYLGKTVQVVPHITDEIQEWIERVAMNPVDGTEEPADVCVIELGGTIGDIESMPFIEALGQFSYRVGPGNFCLVHVSLVPVLNVVGEQKTKPTQHSVRGLRGLGLMPDILACRSTQPLEEHVKVKLAQFCHVPISNIINLRDVTNIWHIPLLLRDQKAHEAILKVLDIQCVGKVAREPQLSEWTERASRCDRLKSPVRIAMVGKYTGLSDSYLSVIKALLHASVALDRKLVVDWVPSCDLEDSAAEENLDAYEKAWELLKGADGVLVPGGFGDRGVQGKILAAKYARENNIPYLGICLGMQIAVIEFARSIMKLHGANSTEFDPTTKTPCVIFMPEGSKTHMGATMRLGSRRTFFQVTNCKSAKLYGNASYVDERHRHRYEVNPDMVPEFEKAGLSFVGRDESGKRMEIIELPTHRFFVGAQFHPEFKSRPGKPSPLFLGLVAASSGQLDHLLQPGLISSTGRHTCSKGGAQKLKAGHVMKPLNGLVNAHYSATGNGAIPI

SEQ ID NO: 3402 - protein, 603 aa, Zea mays
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIFQAVINKERRGDYLGKTVQVVPHITDEIQDWIERVAVVPVDGKEGPPDVCVIELGGTIGDIESMPFIEALGQFSYRVGPGNFCLVHVSLVPVLNVVGEQKTKPTQHSVRGLRGLGLAPDVLACRSTEPLEEHVKAKLSQFCHVPVSNIVNLHDVTNIWHIPLLLRDQKAHEAILKVLDLQYDGKVPREPELTKWTKRATKFDKLKTPVKIAMVGKYTGLSDSYLSVIKALLHASVAMERKLVVEWVPSCDLEDSSAKENPEAHKKAWKLLKGADGVLVPGGFGDRGVQGKILAAKYARENNVPYLGICLGMQIAVIEFARSVMKLRGANSTEFDPATTSPCVIFMPEGSKTQMGATMRLGSRRTYFHVSGCKSAKLYGNASSVDERHRHRYEVNPDMVPDFEKAGLQFVGKDESGKRMGIVELPSHKFFIGAQFHPEFKSRPGKPSPLFLGLIAAASGQLEPLLQRSNPTTKACSISKVPKLKLYPTGPVNNPLNSLVNGYYPNGTGIHT

SEQ ID NO: 3403 - protein, 603 aa, Zea mays
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAVIPVDGKEGPPDVCVIELGGTIGDIESMPFIEALGQFSYRVGPGNFCLVHVSLVPVINVVGEQKTKPTQHSVRGLRGLGLAPDVLACRSTEPLEEHVKIKLSQFCHVPISNIVNLHDVTNIWHIPLLLRDQKTHEAILKVLDLQYDGKVPREPELGMWTKRATKLDKLKTSVKIAMVGKYTGLSDSYLSVIKALLHASVAMERKLVVEWVPSCDLEDSSAKETPEAHKKAWKLLKGADGVLVPGGFGDRGVQGKILAAKYARENNVPYLGICLGMQIAVIEFARSVMKLRGANSTEFDPATTSPCVIFMPEGSKTQMGATMRLGSRRTYFHVSGCKSAKLYANASSVDERHRHRYEVNPDMVPDFERAGLQFVGKDESGKRMGIIELPSHKFFIGAQFHPEFKSRPGKPSPLFLGLIAAASGQLEPLLQRSNPTTKACPMSKVPKLKLYPTGPVNNPLNSLVNGYYPNGTGIHT

SEQ ID NO: 3404 - protein, 605 aa, Oryza sativa
MKYVLVTGGVVSGLGKGVTASSIGVVLKSCGLRITSIKIDPYLNTDAGTMSPFEHGEVFVLDDGGEVDLDLGNYERFLDIKLTRDNNITTGKIYQSVLEKERKGEYLGKTVQVVPHITNAIQEWIERVAMVPVDGKEGPADVCVIELGGTIGDIESMPFIEALGQFSYRVGPGNFCLVHVSLVPVLNVVGEQKTKPTQHSVRGLRGLGLTPNILACRSTKELEENVKEKLSQFCHVPAANIVTLYDVSNIWRIPLLLRDQKAHEAILKVLNLDSFARGPKLDEWVARATLFDALQDTVRIAMVGKYTGLSDSYLSVLKALLHASVDCRRKLLVDWVASTDLEDSTAIEAPDAYKAAWDLLKGANGVLVPGGFGDRGIQGKILAAKYARENNVPYLGICLGMQLAVVEFARSVMNLPEANSTEFDPNAKTPCVIFMPEGSKTHMGGTMRLGSRRTFFEVADCKSAKLYGNVSYVDERHRHRYEVNPDMVPEFENAGLQFVGKDETGRRMEIIEIPNHRYFVGAQFHPEFKSRPSKPSPLFVGLIAASSGQLDRLLQGSCNGHVVSTKHSLSNGAYTSTVHQNGHAKKLANGLSNGTYYPNGNGVHA

SEQ ID NO: 3405 - protein, 602 aa, Oryza sativa
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQSVINKERRGDYLGKTIQVVPHITDEIQDWIERVAMNPVDGKEGPPDVCVIELGGTIGDIESMPFIEALGQFSYRVGPGNFCLVHVSLVPVLNVVGEQKTKPTQHSVRGLRGLGLAPDILACRSTEPLEENVKAKLSQFCHVPVSSIINLHDVTNIWHIPLLLRDQRAHEAILKVLDLQFVGKVPREPKLVEWTERASKFDKLKATVKIAMVGKYTGLSDSYLSVLKALLHASVAMGRKLVVEWVPSCDLEDSAAKETPEAHKKAWKLLKGAEGILVPGGFGDRGVQGKILAAKYARENNVPYLGICLGMQIAVIDFACSIMKLPGANSTEFDPDTMSPCVIFMPEGSKTHMGATMRLGSRRTYFHATACKSAKLYGNARFVDERHRHRYEVNPEMVPEFEKAGLSFVGKDESGRRMEIIELPSHKFFIGVQFHPEFKSRPGKPSPLFLGLIAAASGQLETLLQPSSNIVNPNPMPRFPIPKKTIYHAKKPLDSLVNGYFANGNVIHT

SEQ ID NO: 3406 - protein, 608 aa, Sorghum bicolor
MKYVLVTGGVVSGLGKGVTASSIGVILKACGLRITSIKIDPYLNTDAGTMSPFEHGEVFVLDDGGEVDLDLGNYERFLDIKLTRDNNITTGKIYQSVIDKERKGEYLGKTVQVVPHITNAIQEWIERVAMIPVDGKEGPADVCVIELGGTIGDIESMPFIEALGQFSYRVGPGNFCLVHVSLVPVLNVVGEQKTKPTQHSVRGLRGLGLTPNILACRSTKELEDNVKEKLSQFCHVPAANIISLYDVSNIWRIPLLLRDQKAHEAILKVLNLERVDSIAREPKLDEWVARAAIFDTLHDTVRIAMVGKYTGLSDSYLSVLKALLHASVDCRRKLVVDWVASTDLEDSTAVEAPDAYKTAWDLLKGADGILVPGGFGDRGVQGKILAAKYAREKNVPYLGICLGMQIAVVEYARHVMNLTDANSTEFDPNTKTPCVIFMPEGSKTHMGATMRLGSRRTFFKIADCKSSKLYGNVTYVDERHRHRYEVNPDMVPEFENAGLQFVGKDDTGRRMEIIEIPNHRYFVGAQFHPEFKSRPSKPSPLFVGLIAAASGQLDRVLQDCCNGHVISAKHVLSNGSYTPTVHQNGHPKKLANGLSNGTYYANGNGVHA

SEQ ID NO: 3407 - protein, 602 aa, Sorghum bicolor
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMVPVDGKEGPPDVCVIELGGTIGDIESMPFIEALGQFSYRVGPGNFCLVHVSLVPVLNVVGEQKTKPTQHSVRGLRGLGLAPDILACRSTEPLEEHVKVKLSQFCHVPISNIVNLHDVTNIWHIPLLLRDQKAHEAILKVLELQYDGKVPREPELAKWTKRATKFDKLKTPVKIAMVGKYTGLSDSYLSVIKALLHASVAMERKLVVEWVPSCDLEDSSAKETPEAHKKAWKLLKGADGVLVPGGFGDRGVQGKILAAKYARENNVPYLGICLGMQIAVIEFARSVMKLRGANSTEFDPATTSPCVIFMPEGSKTQMGATMRLGSRRTYFHVNGCKSAKLYGNASSVDERHRHRYEVNPDMVPDFERAGLQFVGKDESGKRMGIIELPSHKFFIGAQFHPEFKSRPGKPSPLFLGLIAAASGQLEPLLQRSNLTTKACPISKIPKLKLYPTGPVNPLNSLVNGYYPNGTGIHT

SEQ ID NO: 3408 - protein, 605 aa, Sorghum bicolor
MKYVLVTGGVVSGLGKGVTASSIGVLLKSCGFRVTSIKIDPYLNTDAGTMSPFEHGEVFVLDDGGEVDLDLGNYERFLDIKLTRDNNITTGKIYQSVIDKERRGDYLGKTVQVVPHITDEIQEWIERVAMNPVDGTEEAADVCVIELGGTIGDIESMPFIEALGQFSYRVGPGNFCLVHVSLVPVLNVVGEQKTKPTQHSVRGLRGLGLMPDILACRSTHPLEEHVKVKLAQFCHVPIPNIINLHDVTNIWHIPLLLRDQKAHEAILKVLDLQCVGKVAREPQLSEWTERASRCDRLKTPVRIAMVGKYTGLSDSYLSVIKALLHASVALDRKLVVDWVPSCDLEDSTAEETPDAYEKAWESLKGADGVLVPGGFGDRGVQGKILAAKYARENNIPYLGICLGMQIAVIEFARSIMKLHGANSTEFDPTTKTPCVIFMPEGSKTHMGATMRLGSRRTFFQVTNCKSAKLYGNVSYIDERHRHRYEVNPDMVPEFEKAGLSFVGRDESGKRMEIIELPTHRFFVGVQFHPEFKSRPGNPSPLFLGLVAASSGQLDQRGVISKTSRCISNTGGASKLKACQNGHLMKPLKGLVNGHYSTTSNGAIPI

SEQ ID NO: 3409 - protein, 602 aa, Saccharum officinarum
  misc_feature (306)..(306): Xaa can be any naturally occurring amino acid
  misc_feature (315)..(315): Xaa can be any naturally occurring amino acid
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMIPVDGKEGPPDVCVIELGGTIGDIESMPFIEALGQFSYRVGPGNFCLVHVSLVPVLNVVGEQKTKPTQHSVRGLRGLGLAPDVLACRSTEPLEKHVKVKLSQFCHVPISNIVNLHDVTNIWHIPLLLRDQKAHEAILKVLELQYDGKVPREPELGKWTKRATKFDKLKTPVKIAMXGKYTGLSDXYLSVIKALLHASVAMERKLVVEWVPSCDLEDSSAKETPEAHKKAWKLLKGADGVLVPGGFGDRGVQGKILAAKYARENNVPYLGICLGMQIAVIEFARSVMKLRGANSTEFDPATTSPCVIFMPEGSKTQMGATMRLGSRRTYFHVNGCKSAKLYGNASSVDERHRHRYEVNPDMVPDFERAGLQFVGKDESGKRMGIIELPSHKFFIGAQFHPEFKSRPGKPSPLFLGLIAAASGQLELLLQRSNLTTKACPINKVPKLKLYPTGPVNPLNSLVNGYYPNGTGIHT

SEQ ID NO: 3410 - protein, 608 aa, Panicum virgatum
MKYVLVTGGVVSGLGKGVTASSIGVVLKACGLRITSIKIDPYLNTDAGTMSPFEHGEVFVLDDGGEVDLDLGNYERFLDIKLTRDNNITTGKIYQSVIDKERKGEYLGKTVQVVPHITNAIQEWIERVAMIPVDGKEGPADVCVIELGGTIGDIESMPFIEALGQFSYRVGPGNFCLVHVSLVPVLNVVGEQKTKPTQHSVRGLRGLGLTPNILACRSTKELEDNVKEKLSQFCHVPAANIVTLYDVSNIWRIPLLLRDQKAHEAILKVLNLDRVESIAREPKLDEWVERATIFDALQNTVRIAMVGKYTGLSDSYLSVLKALLHASVDCRRKLVVDWVASTDLEDSTAIEAPDAYKAAWDLLKGADGILVPGGFGDRGVQGKILAAKYAREKNVPYLGICLGMQIAVVEFARHVMNLTDANSTEFDPDTKTPCVIFMPEGSKTHMGATMRLGSRRTFFKVADCKSAKLYGNVTYVDERHRHRYEVNPDMVPEFENAGLQFVGKDDTGRRMEIIEIPKHRYFVGAQFHPEFKSRPSKPSPLFVGLVAAASGQLDRVLQDCCNGHVVPAKHILSNGSYPSIVHQNGHPKKLANGLSNGTYYANGNGVHA

SEQ ID NO: 3411 - protein, 605 aa, Panicum virgatum
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMNPVDGKEGPPDVCVIELGGTIGDIESMPFIEALGQFSYRVGPGNFCLVHVSLVPVLNVVGEQKTKPTQHSVRGLRGLGLAPDVLACRSTEPLEEHVKVKLSQFCHVPISNIVNLHDVTNIWHIPLLLRDQKAHEAILKVLELQYAGKVPREPKLAEWTERATKFDKLKTPVNIAMVGKYTGLSDSYLSVLKALLHASVAMERKLIVDWVPSCDLEDSSARENPEAHKKAWKLLKGADGILVPGGFGDRGVQGKILAAKYARENNVPYLGICLGMQIAVIEFARSVMKLCGANSTEFDPAATSPCVIFMPEGSKTHMGATMRLGSRRTYFHVNGCKSARLYGNATSVDERHRHRYELNPDMVPDFERAGLQFVGKDESGRRMEIIELPSHKFFIGAQFHPEFKSRPGKPSPLFLGLIAAASGQLEPLLQRSCNNLPKTHVNNGKVQIRKLYPTVPVKSPLTSLVNGYYPNGTGIHT

SEQ ID NO: 3412 - protein, 154 aa, Panicum virgatum
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQSVIDKERRGDYLGKTVQVVPHITDEIQVWIERVAMNPVDGTEEPADVCVIELGWHNRRH

SEQ ID NO: 3413 - protein, 599 aa, Triticum aestivum
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQAVINKERKGDYLGKTVQVVPHITDEIQDWIERVAMNPVDGTDKPADVCVIELGGTIGDIESMPFIEALGQFSYRVGAGNFCLVHVSLVPVLTVVGEQKTKPTQHSVRGLRGLGLMPDILACRSTQPLEENVKLKLSQFCQVPVSNIVNLHDVTNIWHIPLLLRDQRAHEAILKVLGLWCVGKVPQEPKLSEWTERASRFDKLKSPVRIAMVGKYTGISDSYLSILKALLHASVALDRKLVVDWVPSCDLEDSAAVETPDAYEKAWGLLKGANGVLVPGGFGDRGVQGKILAAKHARENNVPYLGICLGMQIAVIEYARSVMKLRDANSTEFDPAAKTPCVIFMPEGSKTHMGATMRLGSRRTFFQVNNCKSAKLYANANYVDERHRHRYEVNPDMVSEFEKAGLSFVGRDESGRRMEIIELPTHKFFVGTQFHPEFNSRPGKPSPLFLGLIAASSGQLEHLLQRTSGAVSSPTRCIAGPGAPKTKLRMNGLVSTYFANGSSIHI

SEQ ID NO: 3414 - protein, 607 aa, Triticum aestivum
MKYVLVTGGVVSGLGKGVTASSIGVVLKACGLRITSIKIDPYLNTDAGTMSPFEHGEVFVLDDGGEVDLDLGNYERFLDIKLTRDNNITTGKIYQSVIDKERKGEYLGKTVQVVPHITNAIQDWIERVAMIPVDGMDGPADVCVIELGGTIGDIESMPFIEALGQFSYRVGPGNFCLVHVSLVPVLNVVGEQKTKPTQHSVRGLRGLGLTPNILACRSTKELEENVKEKLSQFCHVPATNIVTLYDVSNIWRIPLLLRDQKAHEAILKVLNLESFPREPKLDEWVARATMFDTLQDTVRIAMVGKYTGLSDSYLSVLKALLHASVYCHRKLVVDWVASTDLEDSTKIEAPDAYKAAWNLLKSADGILVPGGFGDRGVQGKILAAKYARENNVPYLGICLGMQMAVVEFARHVMNLPHANSTEFDPNAKTPCVIFMPEGSKTHMGGTMRLGSRRTFFKVADCKSAKLYGNADYVDERHRHRYEVNPDMVPEFENAGLKFVGKDESDRRMEIIEIPNHQYFVGAQFHPEFKSRPAKPSPLFVGLIAASSGQLDKVLQGCSNGHVIPGKHQFSNGPYTPAAHQNTNGHAKKLANGVANGTYYPNGNGVHA

SEQ ID NO: 3415 - protein, 550 aa, Brachypodium distachyon
MDGAGGGGGLHGARRNISSASGPRRRALPMENGHDAPSSARRPASASFSRTTSSMAAERTVKRLRLSKALTIPDHTTVYEACRRMAARRVDAVLLTDSNALLCGILTDKDITTRVIARELKLEDTPVSKVMTRNPLFVLSDTLAVEALQKMVQGKFRHLPVVENGEVIALLDIAKCLYDAIARMERAAEKGKAIAAAVEGVEKHWGTAVSGPNTFVETLRERMFRPSLSTIISENSKVVTVAPTDTVLTASKKMLELKVSSAVVAIENKPGGILTSRDILMRVIAQNLPPESTTVEKVMTQSPECATTDTPILEALHTMHDGKFLHLPVLDSDGNVVTVIDVLHITHAAIATVGNSGAAGSEATSSMMQRFWDSAMSSGPLDDDDDSRSEGSTKVASEATDIGRSTFYPASGLSSTFGFKIQDKQGRMHRFNCDTSSLTELITSILQRLGDDIDKLNLPQILYEDEDRDKVILSSDSDLIAAVDHARQIGWKSLRLHLDYAGVGRRKRTSGSTNFEYAGRDAWASAYSTVAAGAALVAGLGVMAYLKRAS

SEQ ID NO: 3416 - protein, 547 aa, Zea mays
MDGGAGAGAGRRNVSSSSGSRRRVLPAENGHGHDAPPPSRRSSVSLSRGHSTSLTGERTVKRLRLSKALTIPDHTTVHEACRRMASRRVDAVLLTDSNALLCGILTDKDITTRVIARELKMEETPVSKVMTRNPVFVLADTLAVEALQKMVQGKFRHLPVVENGEVIAILDIAKCLYDAIARMERAAEKGKAIAAAVEGVEKHWGAAVPGPNNFIETLRERMFRPSLSTIISENPKVVTVAPSDMVLTASKKMLELKVSSAVVAIENKPGGILTSRDILMRVIAQNLPPESTTVMTQSPECATVDTPILDALHTMHDGKFLHLPVLDRDGNVVTVVDVLHITHAAIATVGNSGAAGSEATSAMMQRFWDSAMSIGPIDDDDDSRSEGSTRVVSEATDIGRAAFFPASGLSNTFGFKIQDKQGRMHRFNCETSGLAELITSILQRVGDDIDRKHLPQILYEDEDRDKVVLSSDSDLIAAVDHARKIGWKSIRLHLDYAGVGRRKGGGGPSDLEYAGKDAAWASAYSAVAAGAALVAGLGVMAYLKRSG

SEQ ID NO: 3417 - protein, 238 aa, Oryza sativa
MDGGVGGAHSSRRSVSSSTGSRRRAGPTENGHHDAAAAAAGRRSSASISRASQQSMTGERTVKRLRLSKALTIPDHTTVYEACRRMAARRVDAVLLTDSNALLCGILTDKDITTRVIARELKLEETPVSKVMTRNPLFVLSDTLAVEALQKMVQGKFRHLPVVENGEVIALLDIAKCLYDAIARMERAAEKGKAIAAAVEGVEKHWGASVSGPNTFIETLRERMFRPSLSTIISENSK

SEQ ID NO: 3418 - protein, 547 aa, Sorghum bicolor
MDGGAGAGRRSVSSSSGSRRRLPPAENGHGHDAPPPSRRASVSLSRGPSTTLTSERTVKRLRLSKALTIPDHTTVHEACRRMASRRVDAVLLTDSNALLCGILTDKDITTRVIAREMKMEETPVSKVMTRNPVFVHADTLAVEALQKMVQGKFRHLPVVEHGEVIAILDIAKCLYDAIARMERAAEKGKAIAAAAEGVEKHWGAAVSGPNNFIETLRERMFKPSLSTIISENPKVVTVAPSDTVLTASKKMLELKVSSAVVAIENKPGGILTSRDILMRVIAQNLPPESTTVEKVMTQSPECATVDMPILDALHTMHDGKFLHLPVLDRDGNVVTVVDVLHITHAAIATVGNSGAAGSEATSAMMQRFWDSAMSIGPLDDDDDSRSEGSTKVASEATDIGRSAFFPASGLSNTFGFKIQDKQGRMHRFNCETSSLTDLITSILQRVGDDIDRKHLPQILYEDEDHDKVILSSDSDLIAAVDHARQIGWKSLRLHLDYAGVGRRKRGGGSSDFEYAGKDAWASAYSAVAAGAALVAGLGVMAYLKRSG

SEQ ID NO: 3419 - protein, 241 aa, Panicum virgatum
MDGGAGAAGHGGPGRRTISSAAASRRRLPPAENGHGHGHDGAASRRSSASISRANSPSLTGERTVKRLRLSKALTIPDHTTVHEACRRMASRRVDAVLLTDSNALLCGILTDKDITTRVIARGLKMEETPVSKVMTRNPVFVLADTLAVEALQKMVQGKFRHLPVVENGEVIALLDIAKCLYDAIARMERAAEKGKAIAAAVEGVEKHWGTAASGPKNFIETLREKMFRPSLSTIISENSK

SEQ ID NO: 3420 - protein, 366 aa, Brachypodium distachyon
MENNLPVNIREYQELAKKALPKMHFDYINGGAEDEHTLRENIAAYGRIVLRPRFLVDVSNIDMSTNLLGYDMPSPIMVAPTGAHKLANPEGEVATARAAASCNSVMVLSFSSSCKIEEVASSCNAIRFYQLYVFKNRDISETLIRRAESYGFKAIVLTVDTPVLGRREADIRNKMIVPWNENLEGLLSFDDLDTTDGSKLEKYSRETLDPSLSWKDVEWLKSISSLPILLKGIVTGEDARRAVEAGVAGVIVSNHGARQLDYAPATISALEEVVKAVAGAVPVLVDGGVRRGTDVLKALALGARAVMVGRPVLYGLAARGEAGARHVLEMLNWELEVAMALCGCRSIAGITRDRVQTEGDRIRSLL

SEQ ID NO: 3421 - protein, 366 aa, Leymus cinereus x Leymus triticoides
  misc_feature (310)..(310): Xaa can be any naturally occurring amino acid
MENNLPVNIREYQELAKKALPKMHYDYINGGAEDEHTLRDNIAAYGRILLRPRVLVDVSNIDMSTNLLGYDMPSPIIVAPTGSHKLANPEGEVATARAAASCNTLMVLSFSSSCKIEEVGSSCNAIRFYQLYVFKKRDVSATLVRRAESCGFKAIVLTVDTPMLGRREADIRNKMVAPANANLEGLMPIDDLDTADGSKLEKYARDTLDPSLSWKDVEWLKSITSLPILLKGIVTAEDARKAVEAGAAGIIVSNHGARQLDYAPATISALEEVVKAVAGAVPVLVDGGVRRGTDVLKALALGARAVMVGXPVLYGLAARGEAGAKHVIEMLNRELELAMALCGCRSVTEITRDRVQTEGDRFRSLL

SEQ ID NO: 3422 - protein, 367 aa, Zea mays
MEDNLPVNVREYQELAKKALPKMHYDYINGGAEDEYTLRENIAAYGRILLRPRVLIDVSKIDMSTSLLGYNMPSPIIVAPTGAHKLANPEGEVATARAAAACNTIMMLSFSSSCRIEEVASSCDAIRFYQLYVYKRRDVSATLVRRAESLGFRAIVLTVDTPVLGRREADIRNKMIAPPLSNLEGLMSLDDFDDAEGGSKLERFSRETLDPSLSWKDVEWLKSITSLPILLKGIVTAEDARKAVEAGAAGLIVSNHGARQLDYAPATISALEEVVKAVAGAVPVLVDGGVRRGTDVLKALALGAKAVMVGRPVFFGLAARGEAGARHVIEMLNKELELAMALCGCRSVAEVTRAHVQTEGDRIRALL

SEQ ID NO: 3423 - protein, 367 aa, Sorghum bicolor
MEDNLPVNVREYQELAKKALPKMHYDYINGGAEDEYTLRENIAAYGRILLRPRVLIDVSKIDMSTSLLGYNMPSPIIVAPTGSHKFANPEGEVATARAAAACNTIMVLSFSSNCRIEEVASSCDAIRFYQLYVYKRRDVSATLVRRAESLGFRAIVLTVDTPVLGRREADIRNKMIAPQLSNLEGLMSLDDFDGGEGGSKLERFSRETLDPSLSWKDVEWLKSITSLPILLKGIVTAEDARKAVEVGVAGVIVSNHGARQLDYAPPTISALEEVVKAVAGAVPVLVDGGVRRGTDVLKALALGAKAVMVGRPVFYGLAARGEAGARHVIEMLNKELELAMALCGCRSVAEVTRAHVQTEGDRIRALL

SEQ ID NO: 3424 - protein, 367 aa, Saccharum officinarum
MEDNLPVNVREYQELAKKALPKMHYDYINGGAEDEYTLRENIAAYGRILLRPRVLIDVSKIDMSTSLLGYNMPSPIIVAPTGSHKLANPEGEVATARAAAACNTIMVLSFSSSCRIEEVASSCNAIRFYQLYVYKRRDVSATLVRRAESLGFKAIVLTVDTPVLGRREADIRNKMVAPRLSNLEGLMSLDDFDGGEGGSKLERFARETLDPSLSWKDVEWLKSITSLPILLKGIVTAEDARKAVEAGAAGVIVSNHGARQLDYAPATISVLEEVVKAVAGAVPVLVDGGIRRGTDVLKALALGAKAVMVGRPVFYGLAARGAAGARHVIEMLNKELELAMALCGCRSVAEVTRAHVQTEGDRIRALL

SEQ ID NO: 3425 - protein, 367 aa, Panicum virgatum
MEDNLPVNVREYQELAKKALPKMHYDYINGGAEDEYTLRENIAAYGRILLRPRVLIDVSKIDMSTTLLGYNMPSPIIVAPTGAHKLANPEGEVATARAAAACKTVMVLSFSSSCKIEEVASSCDAIRFYQLYVYKRRDVSATLVRRAESLGFKAIVLTVDTPVLGRREADIRNKMVAPRMPNLEGLMSFDDDLDSEGGSKLERFAHETLDPSLSWKDVEWLKSITSLPILLKGIVTAEDARKAVEVGAAGVIVSNHGARQLDYAPPTISALEEVVKAVAGAVPVLVDGGVRRGTDVFKALALGATAVMVGRPVFYGLAARGEAGARHVIEMLNRELELAMALCGCRSVAEVTRRHVLTEGDRIRALL

SEQ ID NO: 3426 - protein, 367 aa, Panicum virgatum
MEDNLPVNVREYQELAKKALPKMHYDYINGGAEDEYTLRENIAAYGRILLRPRVLIDVSKIDMSTTLLGYNMPSPIIVAPTGAHKLANPEGEVATARAAAACNTIMVLSFGSSCKIEEVASSCDAIRFYQLYVYRRRDVSATLVRRAESLGFKAIVLTVDTPVLGRREADIRNKMVAPRMANLEGLMSFDDDIDSKGGSKLERFAHETLDPSLSWKDVEWLKSITSLPILLKGIVTAEDARKAVEVGAAGVIVSNHGARQLDYAPPTISALEEVVKAVAGAVPVLVDGGVRRGTDVFKALALGATAVMVGRPVFYGLAARGEAGARHVIEMLNRELELAMALCGCRSVAEVTRRHVLTEGDRIRALL

SEQ ID NO: 3427 - protein, 56 aa, Hordeum vulgare
MYTNPPSGQEMSYTDHVQRRHEEKGCLYACVFTALCCFCCYETCECCLDCLCCCCN

SEQ ID NO: 3428 - protein, 55 aa, Hordeum vulgare
MYDAPSGQEMSYTDHVQRRHEEKGCLYACVFTALCCFCCYETCECCLDCLCCCCN

SEQ ID NO: 3429 - protein, 55 aa, Hordeum vulgare
MYNAPSGQEMSYTDHVQRRHEEKGCIYACVFTALCCFCCYETCECCLDCICCCCN

SEQ ID NO: 3430 - protein, 55 aa, Hordeum vulgare; identical to SEQ ID NO: 3428

SEQ ID NO: 3431 - protein, 55 aa, Hordeum vulgare; identical to SEQ ID NO: 3428

SEQ ID NO: 3432 - protein, 55 aa, Brachypodium distachyon
MYNAPMAQEMSYLDHMQRRHEEKGCLYACLFTALCCFCCYETCECCLECLCCCCD

SEQ ID NO: 3433 - protein, 55 aa, Theobroma cacao
MYNAPSAQEMSYFEHVQRRHEEKGCLYACIFTALCCFCCYETCECCLDCLCCSCN

SEQ ID NO: 3434 - protein, 55 aa, Festuca arundinacea
MYNAPSAQEMSYSDHVQRRHEEKGCLYACVFTALCCFCCYETCECCLDCLCCCCN

SEQ ID NO: 3435 - protein, 55 aa, Festuca arundinacea; identical to SEQ ID NO: 3434

SEQ ID NO: 3436 - protein, 55 aa, Leymus cinereus x Leymus triticoides
MYNAPSGQEMSYTDHVQKRHEEKGFIYACVFTALCCFCCYETCECCLDCLCCCCN

SEQ ID NO: 3437 - protein, 55 aa, Lolium multiflorum
MYNAPSAQEMSYSDHVQRRHEEKGCLYACVFTALCCFCCYETCECCLECLCCCCN

SEQ ID NO: 3438 - protein, 55 aa, Eragrostis curvula
  misc_feature (18)..(18): Xaa can be any naturally occurring amino acid
MYNAPTAQEMSYFDHVQXRHEEKGCLYACIFTALCCFCCYETCECCLDCLCCCCN

SEQ ID NO: 3439 - protein, 54 aa, Zea mays
MYNPPSGQDMSYYDHVQKRHEEKGCLYACLFTACCCFCCFETCECCLEAICCCC

SEQ ID NO: 3440 - protein, 54 aa, Zea mays; identical to SEQ ID NO: 3439

SEQ ID NO: 3441 - protein, 55 aa, Zea mays
MYNAPSAQEMSYLEHVQRRHEEKGCLYACIFTALCCFCCYETCECCLDCLCCCCN

SEQ ID NO: 3442 - protein, 54 aa, Pennisetum glaucum
MYNPPSSQDMSYYDHVQKRHEEKGCLYACLFTACCCFCCYETCECCIEAICCCC

SEQ ID NO: 3443 - protein, 55 aa, Pennisetum glaucum
MYDAPTAQEMSYYDHVQRRHEEKGCLYACVFTALCCFCCYETCECCLDCLCCCCN

SEQ ID NO: 3444 - protein, 55 aa, Avena sativa
MYNAPSSQEMSYSDHVQRRHEEKGCLYACVFTALCCFCCYETCECCLDCLCCCCN

SEQ ID NO: 3445 - protein, 54 aa, Ananas comosus
MYNPPSAQEMSYFEHVQKRHEEKGCLYACLFVLCCCFCCYETCECCLDCLCCCC

SEQ ID NO: 3446 - protein, 55 aa, Oryza sativa
MYNAPMAQDMSYYEHVQRRHEEKGCLYACIFTALCCFCCYETCECCLDCLCCCCN

SEQ ID NO: 3447 - protein, 54 aa, Sorghum bicolor
MYNPPSAQDMSYYGHVQKRHEEKGCLYACLFTACCCFCCYETCECCLEAICCCC

SEQ ID NO: 3448 - protein, 55 aa, Sorghum bicolor
MYNAPSAQEMSYFEHVQRRHEEKGCLYACIFTALCCFCCYETCECCLDCLCCCCN

SEQ ID NO: 3449 - protein, 55 aa, Saccharum officinarum; identical to SEQ ID NO: 3448

SEQ ID NO: 3450 - protein, 54 aa, Saccharum officinarum
MYNPPSAQDMSYYDHVQKRHEEKGCLYACLFTACCCFCCYETCECCLEAICCCC

SEQ ID NO: 3451 - protein, 55 aa, Saccharum officinarum; identical to SEQ ID NO: 3448

SEQ ID NO: 3452 - protein, 54 aa, Panicum virgatum
MYNPPSTQEMSYYDHVQKRHEEKGCLYACLFTLCCCFCCYETCECCIETICCCC

SEQ ID NO: 3453 - protein, 55 aa, Panicum virgatum
MYNAPSAQEMSYFDHVQRRHEEKGCLYACIFTALCCFCCYETCECCLDCLCCCCN

SEQ ID NO: 3454 - protein, 55 aa, Panicum virgatum; identical to SEQ ID NO: 3453

SEQ ID NO: 3455 - protein, 54 aa, Panicum virgatum
MYNPPSAQEMSYYDHVQKRHEEKGCLYACLFTLCCCFCCYETCECCLETICCCC

SEQ ID NO: 3456 - protein, 55 aa, Triticum aestivum
MYNAPSGQEMSYTDHVQKRHEEKGCIYACVFTALCCFCCYETCECCLDCLCCCCN

SEQ ID NO: 3457 - protein, 55 aa, Triticum aestivum
MYNAPSGQEMSYTEHVQKRHEEKGCIYACVFTALCCFCCYETCECCLDCLCCCCN

SEQ ID NO: 3458 - protein, 55 aa, Triticum aestivum; identical to SEQ ID NO: 3456

SEQ ID NO: 3459 - protein, 55 aa, Triticum aestivum; identical to SEQ ID NO: 3457

SEQ ID NO: 3460 - protein, 55 aa, Triticum aestivum
MYNPPSGQEMSYTDHVQKRHEEKGCIYACVFTALCCFCCYETCECCLDCLCCCCN

SEQ ID NO: 3461 - protein, 54 aa, Triticum aestivum; identical to SEQ ID NO: 3439

SEQ ID NO: 3462 - protein, 55 aa, Triticum aestivum; identical to SEQ ID NO: 3456

SEQ ID NO: 3463 - protein, 55 aa, Triticum aestivum; identical to SEQ ID NO: 3456

SEQ ID NO: 3464 - protein, 72 aa, Triticum aestivum
LNLAGERRGAQPAGGKMYNNPPPPQGMSYYEHAQKRHQEKGCLYACVFTALCCFCCYETCECCLDCLCCCCN

SEQ ID NO: 3465 - protein, 56 aa, Triticum aestivum
MYNNPPPPQGMSYYEHAQKRHEEKGCLYACVFTALCCFCCYETCECCLDCLCCCCN

SEQ ID NO: 3466 - protein, 55 aa, Triticum aestivum
MYDAPSAQEMSYMDHVQRRHEEKGCIYACVFMALCCFCCYETCECCLDCLCCCCN

SEQ ID NO: 3467 - protein, 49 aa, Triticum aestivum
  misc_feature (5)..(5): Xaa can be any naturally occurring amino acid
GQEMXYTDHVQRRHEEKGCLYACAFTALCCFCCYETCECCLDCLCCCCN

SEQ ID NO: 3468 - protein, 55 aa, Triticum aestivum; identical to SEQ ID NO: 3457

SEQ ID NO: 3469 - protein, 209 aa, Hordeum vulgare
MGVECRYEVAQAAYVKLALHALKHPAAAVNGLLVGRLADPAASPAAVVSVADAVPLSHQPHHLPLLPTLELALTLVEDHFQPQGLAVVGYYHANARRDDADLPAVAKRVGDHIFRYFPRAAVLLLDNVKLEEVVKGNSRDAVVQLYTRDSSKSWRQAGSDGSSQLKLKEPSTNVVLADHVTTKKWQQVVDFDDHLDDISKDWLNASLLG

SEQ ID NO: 3470 - protein, 207 aa, Brachypodium distachyon
MGVECRYEVAQAAYVKLALHALKHPTAAVNGLLVGRLLDSASPAVVSVVDAVPLSHQPHHLPLLPTLELALTLVEDHFAPQGFAVVGYYHANARRDDTDLPAVAKRVGDHIFRYFPRAAVLLLDNQKLEKVIKGDSRDPVVQLYSRDSSKSWRQAGSDGSSQLTLKEPSTNVVLADHVTTKKWQQIIDFDDHLDDISKDWLNPSLLG

SEQ ID NO: 3471 - protein, 209 aa, Oryza sativa
MGAECKYEVAQVAYVKLALHALKHPAAAVNGLLVGRLLDGAASPAAVVSIADAVPLSHHPHHLPLLPTLELALTLVEDHFAAQGLAVVGYYHANARRDDADLPPVAKRVGDHVFRNFPRAAVLLLDNKKLEEAVKGKSREPVVQLYTRDSSKSWRQAGSDGSSQLTLKEPSTNMVLADHVTTKKWQQVVDFDDHLDDISKDWLNPGLLA

SEQ ID NO: 3472 - protein, 208 aa, Secale cereale
MGVECRYELAQAAYVKLALHALKHPAAAVNGLLVGTLADTAASPAVVSVVDAVPLSHQPHHLPLLPTLELALTLVEDHFQAQGLAVVGYYHANARRDDADLPAVAKRVGDHIFRYFPRAAVLLLDNVKLEEVVKGNSRDAVVQLYTRDSSKSWRQAGSDGSSQLKLKEPSTNVVLADHVTTKKWQQVVDFDDHLDDISKDWLNASLLG

SEQ ID NO: 3473 - protein, 210 aa, Sorghum bicolor
MGADCRYELAQAAYVKLALHALKHPATAVNGLLVGRLVEPSSSPAVVSVIDAVPLSHHPHHLPLLPTLELALTLVEDHFATQGEGLAVVGYYHANPRCDDTDLPPVAKRVGDHIFRYFPRSAVLLVDNKKLEEAVKGKSRDPVAQLYTRDSSKSWRQAGSDGSSQLVLKEPSTNVVLADHVTTKKWEKIVDFDDHLDDISKDWLNPGLLD

SEQ ID NO: 3474 - protein, 210 aa, Sorghum bicolor
MGAECRYEVAQAAYVKLALHALKHPATAVNGLLVGRLVEPSSSPAVVSVIDAVPLSHHPHHLALLPTLELALTLAEDHFATQGEGLAVVGYYHANPRCDDTELPPVAKRVGDHIFRYFPRSAVLLVDNKKLVEAVKGKSRDPVVQLYTRDSSKSWRQAGSDGSSQLVLKEPSTNVVLADHVTTKKWEKIVDFDEHLDDISKDWLNPGLLD

SEQ ID NO: 3475 - protein, 210 aa, Saccharum officinarum
MGAECRYELAQAAYIKLALHALKYPATAVNGLLVGRLVEPSSSPAVVSVIDAVPLSHHPHHLPLLPTLELALTLVEDHFATQGEGLAVVGYYHANPRCDDTDLPPVAKRVGDHIFRYFPRSAVLLVDNKKLEEAVKGKSRDPVVQLYTRDSSKSWRQAGSDGSSQLVLKEPSTNVVLADHVTTKKWEKIVDFDDHLDDISKDWLNPGLLD

SEQ ID NO: 3476 - protein, 189 aa, Saccharum officinarum
  misc_feature (149)..(149): Xaa can be any naturally occurring amino acid
MGAECRYDVAQAAYLKLALHALKHPATAVNGLLVGRLVEPSSSPAVVSVIDAVPLSHHPHHLPLLPTLELALTLVEDHFATQGEGLAVVGYYHANPRCDDTELPPVAKRVGDHIFRYFPRSAVLLVDNKKLEEAVKGTSRDPVVQLYTXDSSKSWRQAGSDGSKQLGLKEPSTNVVLAGHVQQRNGKYW

SEQ ID NO: 3477 - protein, 210 aa, Panicum virgatum
MGAECRYEVAQAAYVKLALHALKHPSAAVNGLLVGRLVEPSSTPAVVSVVDAVPLSHHPHHLPLLPTLELALTLVEDHFATQGEGLAVVGYYHANPRRDDADLAPVAKRVGDHIFRYFPRSAVLLVDNKKLEEAVMGKSREPVVQLYTRDSSKSWRQAGSDGSSQLALKEPSTNVVLADHVTTKKWEKIVDFDDHLDDISKDWLNPGLLD

SEQ ID NO: 3478 - protein, 208 aa, Triticum aestivum
  misc_feature (169)..(169): Xaa can be any naturally occurring amino acid
MGVECRYEVAQAAYVKLALHALKHPAAAVNGLLVGRLADPAASPAVVSVADAVPLSHQPHHLPLLPTLELALTLVEDHFQAQGLAVVGYYHANARRDDADLPAVAKRVGDHIFRYFPRAAVLLLDNVKLEEVVKGSSRDAVVQLYTRDSSKSWRQAGSDGSSQLKLKEXSTNVVLADHVTTKKWQKVVDFDDHLDDISKDWLNASLLG

SEQ ID NO: 3479 - protein, 208 aa, Triticum aestivum
MGVECRYELAQAAYVKLALHALKHPAAAVNGLLVGTLADPAASPAVVSVADAVPLSHQPHHLPLLPTLELALTLVEDHFQAQGLAVVGYYHANARRDDADLPAVAKRVGDHIFRYFPRAAVLLLDNVKLEEVVKGNSRDAVVQLYTRDSSKSWRQAGSDGSSQLKLKEPSTNVVLADHVTTKKWQQVVDFDDHLDDISKDWLNASLLG

SEQ ID NO: 3480 - protein, 356 aa, Oryza sativa
MEETSSEAADRSLRQKAAAMVASSMETYRSKPMSFWLLLVLSAGAMLTAFPASSLLSRLYYNNGGQSKWILSWSAVAGWPLPALLLLPCYLAGKAAPTPLSPKLCAWYALLGLLSAADNLMYAWAYAYLPASTASLVAASSLAFSALFGCAIAKNRLRLSSLNAVVVITAGVVIIALDSGSDRYPGITGRQYALGLVWDVLGSALHGLIFALSELVFVRVLGRRSFHVVLEQQAMVSLCAFAFTTVGLAVSGGGFPAMRREAAAFRHGEASYAMVMVWSAVTFQLGVLGGTGVLFLASTVLAGVLNAVRVPVTSIAAVIWFHDPMSGFKILSLLITVWGFGSYMVGHSSTKKASTN

SEQ ID NO: 3481 - DNA, 644 bp, Oryza sativa
agtaggcaatcatgtgtgagggcgagaagaagaaggactcgtcaagcggcgcgctctactgcgtcaacctcgccctccgcatcgtcgtcctcgggctcgccgtcgccgcggcggcgctcatggcgacggcgagccagtgcaccatcttcctctactacggcggccctctccacaccatcacctacaaggactttggccccttcgtgtatttggtggtggcgagctcgatcggggcgttcatggaggcgatcgccatcttcctgaccatctgcaagaagaaggacggcacgccggcgaaggtgctcctgccgctgctggacgccgccgtgccggtgctgctctactcggcgacggccgccgcgttcgccgccggcgacatgtcgtactgcgccgtggggaagcgcgtcggcgtctgcaccaccgccgccgccggcaacttctgcaaccaggtgcacattgccatgtacgtctccctcgccgccggcgtcgccctgctcgtcgccgagatcgtcaagcactggccggactccgggaagaagaaggaaggcggcggcggcggatgcgggtcggactccgactccgacaagtcaaccccttgccaccatggctgccatagcaagcattagtcgagctctctagcttag

SEQ ID NO: 3482 - DNA, 1501 bp, Oryza sativa
cggtaggtagatgaaattaaggaacacagcaataacacgagctaactcagcctgtcttccaatggaggattgtgttggtatcaagtacagcagtgtcaatgagggcgaagagcgtaagggaggccatggcgtcccaaaggtttccatcatcccactcattttcctcatattctatgaagtttctgggggtccgtttgggattgaggatagtgtcaaggctgctggcccactcctagcaattgctggatttctgctgtttgcactcatatggagtgtcccggaagccctgattactgcagagatgggcactatgtttcctgagaatggtggttacgtcgtctgggtctcttcagcccttgggccattctggggttttcagcaaggctgggcaaagtggctgagtggtgtcatagataatgctctctatccagtcctcttcctcgactatgttaagtccagcattccagctcttggaggtggtctcccaaggaccttggcggtgcttatcctcacagttgcacttacttacatgaactacagagggttgacaatagttggctgggtggcagtctttcttggcgtgttctctctactcccgttttttgttatgggattaatagctattccccgaatcgaaccctcaagatggcttgaaatggacttggggaatgtgaattggggtttatatctaaacacactgttttggaacctcaattattgggactcaatcagtacccttgctggagaggttgagaatccaaagagaacactcccaagggcactttcttatgctctagttttagtggtggggggatacctctaccctctgatcacctgtacagcagcagttccagttgttcgggagttctggacggatggatatttctcagacgttgcgagaattcttggtggtttctggttgcactcgtggcttcaagcagctgctgcactgtccaacatgggcaatttcgtaactgaaatgagcagtgattcttaccagcttctcgggatggctgagcgtggaatgcttccagagtttttcgccaagagatctcgctatggaaccccacttattggcatcatgttctccgcgtttggtgtggtcctgctgtcctggatgagcttccaggagatcatcgctgcggagaactacctgtactgcttcggtatgatcctggaattcatcgccttcatcaagctgagggtggtccacccaaacgcctcccgaccttacaagatcccactgggcaccatcggcgctgtcctgatgatcatcccacctaccattctgatcgtcgtggtgatgatgctcgcgtccttcaaggtgatggtggtcagcatcatggcaatgctggttgggttcgtgctgcagccggctctggtgtacgtggagaagagacggtggctgaagttctccataagcgcagaactgccagatttgccgtactcgaacgttgaggaagacagcacaatcccacttgtgtgctgacctgcatattag

SEQ ID NO: 3483 - DNA, 1931 bp, Oryza sativa
atttatctgcttcaatggcaacttcttggtctgttgctttcactatcttcttctcctgtattctcctgcttgaaaccatctcttcttcagtagcatctcttgattgctcatatggttcagctcaagtgaagatactgtccagctcggtggtcagtgagcagcaaaatgtgtacctcttcttgaagccgtttcagagcacgagatcatgcagcgcgaggcggctcgccggcgaattcgtcaatggcgtcgtcgtgcccaacctgcggctcaacgtcaccggcgtcgtggtcacggccaacgagcggcagctcggcgcgctgcgctgcacgctggagtcggttcaggcggagctcgccgtcgccggattgggtcggagcgtcaaggtctcgccggagctctcgctgccttctctgcgagccatggcgaagtgccgccgccgcggcgagaagcattggcgcagagtcatggagttcgtgaggaggtcaggctcgtttgtcgtggtggagatgggtgcagaagagaaggcagacctcgccgtcgccgatgtcgccgccgcgttcgaggagggcgtcggcgtggcgttccgtatcagcggccgcgcggctcggagcgcggcggaaatggcgaggctgatcggcgatgcggataaggggaggaggtggacgggtgttcttgcggaggttgcgtctccctctccccggcgggagctcgccgcggcggcaaggacgacggcgcgcgacgtgttcgcgccggtgactaaccctacgacgacgccggcgacgaacccggtgacggtgcccgcgacgaacccggcgatgaacccggtgacgccgggcatcgtcaccgtgccgtcgaccaacccggccacgggatactccaacaaccccaacctcccgccgctgtacccggagccgacgccggtgacgatgcccgacccgacgacgacgacgacgccgacgccattcatgaacccggtcaccgcgccgaccatgccatccccggtgaccaaccccgccacgacgccggccgtcacaaacccaacgacgatgccttacccgtacccgccgcagcaaggcggcgtcatgccgacgactccgacttaccagccgccggcgacgatgccggcggcgggcgggcagacgtggtgcgtggcgaaggcggggctgatggacgcggcgctgcagagcgggctggactacgcgtgcggcatgggcggggccgactgcacggcgatccagcccatgggggcctgctacaacccaaacaccctgcaggcccacgcctcctacgccttcaactcctacttccagaggaacccctcgccggcgagctgcgacttcggcggcgccggcatgctcgtcaacatcaacccaagttcaggaacttgcttgtttcaggcatcatcagcaggctacggcgcgggatacagcccgggggtgacggggacagtgccggtgggcggcggcgcgggcgccggcgccggggtcggcgtcggcgtgacgccgatgggaccggcggtgggcggcaccggaggcgccggagtgacgccgatgggaccggcggtgggcggcggatcggggtcgacggtgctcaacgccaacagccccggcgggaactcgatgtacggctccgacagtaacccgacgagcctcaccggcgccgccgccgccgcgctgtcatccggctgggtcctgtgccttgtctggatattcacctttgcatatgtcaaggagaaagtgtaggccttcttcttgctgctgctgctgctactgatgatgaacaacttgttctacttgattcagctgtgtacagatgcatactagatgatttgagtgaattttcataggggagaagaaggatagatgttttgtgagtctgtctgtaatctgtatatgactgtttatgagctgggtaggcagaatgatgcttag

SEQ ID NO: 3484 - DNA, 1649 bp, Oryza sativa
acctcgaaaccctagatcgccatatggcctcctccgccgccgccgccttctaccgcgacagggaggacgcggcgccgccgtcgtccggccccgggggaggcggcgccatggcggcgtacgacccgagctacgtgccggactcggtgaagacgttcgtgtcgcacctctaccgccacatccgcgaccgcaacgtgtacgagacgcaccagatgtacgagggcgggttcacccgcctctccgaccgccacttccgcgacacgccgtggccgccggcggaggccgtggcggcgcactgcgacggcgaccacgtcttcctcctcctctaccgggagctctggttccgccacgcccacgcccgcgtccagggcctcaccccggcgcagcgcgccgagtcgtgggacaactactgctccctcttcagcgtcgtcctccagggcgtcgtcaacatgcagctccccaaccagtggctctgggacatggtcgacgagttcgtctaccagttccagagcttctgccagtaccgcgccaagctcaagaacaagacccacgaggagatcgccctcctcaagcagtacgaccaggcatggagtgtttatggggttcttaattacttgaaagcactggtggagaagtcaatgattggagagatcctggagagggagaaggtagggcttgaacagttcacggcaactgatgggtatgactatgagggcgggagcaatgtgttgaagatgctggggtactacagcatgattgggctgctcagggtgcattgccttcttggggattaccatactgggctcaagtgcttggctccaatagatataagccagcagggtgtctacaccactgtgattggaagccacatttccactatttatcactatgggtttgccagcctcatgatgcgcaggtatattgatggtatacgtgaattcaacaaaattctgttgtatatcctgaagtgtaagcaataccaccagaattccccccagtatgaccagctacttaagaagaatgagcagatgtatgcactattggcgatctgcctctcattgtgtccacaggacaagctcatagatgaaaacgttggcactcagctgaaggaaaagtatggggacaaaatgacaaagatgcataggtatgatgatgaggcatatgctatttatgatgaactcttttcctatgcctgccccaagttcattactgcgtcgcctccagttctacgagagccatacacaaactacaaccaggatgcttatcgtcttcagttgaaactatttctttatgaagtgaaacaacaacagttgctctctggtattcgaagctatctcaagttgtattcaacgataacaattggtaaacttgccaaatacatggatgtggatgaggttacactaaggacaattcttatgacatacaagcacaaaatgcattcaatcgacagtgacggaaaggtcatatccagtgcagactttgacttctatattgatgaggacattattcatgttgttgaatccaagttaaccaagaaccatggtgattactttttgagacagattttgaagtttgaggagatgattacgcagctggataaagtacaatttgactgaacctgctatcatcagggctgaagctctcctttgagt

SEQ ID NO: 3485 - DNA, 1003 bp, Oryza sativa
tcctcttctcaaactccatctctctctcttcttcttcttcctctcctcctcctcctcgcttggaccccggattttttgcaagggggtaaggaggcgggaggagatggggagggaggagaggttcccggtgtgggaggcggcgctcggcgccggggtcgccgccgccttcgccaccgggctcgtcggagtctacctctccatgccggactccgactacagcttcctcaagttgccgcgcaacctcgaggagctccaaatcctcactggacatcttgagaactataccagtgattacaccatacaagtgttggtgggttactgttctgtgtacatcttcatgcagaccttcatgatcccaggaacaatattcatgtcattgcttgccggttctctgtttgggcaactccggggtgtggccctcgtggtatttgcagcctctgctggtgcttcttcgtgctttttcctgtcgaagctgattggaaagccattggtgttctcactgtggccagataagctcatgttcttccagaagcaggttgccaaaagaagagaaaagctgttgaattacatgctttttctcagggtcaccccaacattgccaaacaccttcattaacttagcttcacccatagtagatgtgccctaccatatattcttactggcaactctcatcggtctcatcccagcttcctatgttactgtcagggctgggattgctctaggagagttaacatcattgagtgacctgtatgatacccaatcgatagcgctgctgttcttgatcgggattgtttcggtcacaccaacattgttgggcaaggacgaagcgcaagaaaaaacaacggaaattgcagttaccgcgtcatgatcaccgaagcgccgatccgcatgccctcacctgtacatatgaagctccagcatgcagggttgcttcagaagtagtaggagcatcaaaggcctgacaacaccatggtttgcaaagactacacagcatgacaggacc

SEQ ID NO: 3486 - DNA, 3188 bp, Oryza sativa
aaccacgcgaagacatggcattcccgagcggcaaagcctactacctccacctcctcctgctcgcgatcctgccaagcctcgtcgcgcggcgcggcgcggcgcagcagggcggcgtcgacgagaagcagctcctgctccaggtcaagcgcgcgtggggggaccccgcggcgctcgcgtcgtggacggacgcggcgccgcactgccgctgggtgtacgtgtcctgcgacggcggcggcaccggccgcgtcacgtcgctgtccctccccaacgtcgcggtcgccggcgccgtccccgacgccatcggcgggctgacggcgctcacggtgctcaacctccagaacaccagcgtcggcggcgtgttcccggcgttcctctacaacctcaccgcgatcacctccatcgacctctcgatgaacagtatcggcggcgagctccccgccgacattgaccggctcggcaagaacctgacctacctcgccttgaacaacaacaacttcaccggcgtgataccggcggcggtgtcgaagctcaagaacctgaaggtgtttaccctcaactgcaaccagctcaccggcacgatcccggcggcgctcggcgagctcactagcctcgagacgctcaagctcgaggtgaatcagttcacccccggcgagctgccgggatcgttcaagaacttgacgagcctgaagacggtctggctggcgcagtgcaacctcaccggcgatttccccagctacgtcacagagatgatggagatggagtatctcgacctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcactgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctctgcgtatcggcggcgccggcgggtaacttcgcgggcctgcgctcgtgcgccgcgaaggcatccgacggcgtatcgccgggtctccggtcgggtctcctcgccgccggcgcggccctcgtcgtcttgatcggggcgctcgccttcttcgtcgtccgcgacatcaagaggcggaagcggctcgcgcggacagagccggcatggaagatgaccccattccagcccctcgacttcagcgaggcctcccttgtgcgcgggctcgccgacgagaacctcatcggcaagggcggcgcggggcgcgtgtaccgcgtcgcgtacgccagccggagcagcggcggcgccggcggcaccgtcgccgtgaagcgcatatggaccggcggcaagctggacaagaacctggagcgcgagttcgattcggaggtggacatcctcggccatgtccgccacaccaacatcgtgaagctcctctgctgcctctcccgcgcggagacgaagctcctcgtgtacgagtacatggagaacggcagcctcgacaagtggctccacgggaacaaattgctggccggtggcgcgacggcgagggcgccgtcggtccggcgagcgccgctggactggctggcgagggtcagggtggccgtcggcgcggcgaggggcctctgctacatgcaccacgagtgctcgccgccgatcgtgcaccgggacatcaagtccagcaacatcctgctcgacgctgagctcatggccaaggtcgccgacttcgggctcgcccggatgctggtccaggccgggacgccggacaccatgaccgccgtcgccggatcgttcggctacatggctcccgagtgcgcgtacacgaggaaggtgaacgagaaggtcgacgtgtacagcttcggggtggtgctcctcgagctgatcaccggcagggaagcccacgacggcggcgagcacggctcgctggcggagtgggcgtggcggcacctgcaatcgggcaggagcatcgccgacgcggtggacaggtgcatcaccgacgccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatcc

SEQ ID NO: 3487 - DNA, 311 bp, Oryza sativa
agtcagatccattcctcctcccattctcgatcgcgaggaggaggagaccccgcccgccagccaccccggatccgtcgatcgccatggcggatgaagaacctgttgatccaaagaagtaccttgaggagcgctgcaagccccagtgcgtaaagccactctatgagtatgagaagtgcgtcaagagagtggagaaggatgatactgggcataaacactgcactgggcaatatttcgactattggtcatgcattgacaaatgtgtagcaccgaaactccttgagaagctcaaatgatgaccggctgctactttt

SEQ ID NO: 3488 - DNA, 3812 bp, Oryza sativa
cttccccgatagaaatccatccctcccgccgccgccgccgccgccgctcctagggttccggcacctccccgaatccccccctcacttcgacccctgttcgcttcacccgccgccgccatggcggagaagctgagggatctgagccagcccatagacgtcccgctgctggacgccactgtcgccgccttctacggcaccggatctaaggaagagaggaatgccgctgatcagatactacgggatctacagaataatccagatatgtggctgcaggtggtccacattctgcagaattctcacaacttgaacaccaagttctttgccctccaagtacttgaaagtgttataaagtataggtggaatgcattgccaactgaacaacgtgatggcatcaagaattacatatctgatgttattgtccagctctccagtaatgaggcttcttttcggcaagagagactttatgttaataaactcaacattatactggtgcaggttctgaagcatgagtggccagctaggtggtcatctttcgttcctgaccttgttgctgctgcaaagagtagtgaaaccatatgcgaaaattgcatggctatattgaagcttttaagcgaagaaatttttgatttttcaagaggtgaaatgacacaacagaagattaaagaactgaagtcatcacttaacagtgaatttcgtcttattcatgagctatgtttatatgtcctatctgcaacacaaagacctgagctcatccgtgctacactggctacacttcatgctttcttatcatggataccagtgggcttcatatttgagtcacctttgctggagacattactgaagttctttcctatggctgcttatcggaaccttacactccagtgccttacagaggtcgctgctcttcagtttggtgatttttataatgtgcagtatgtgaagatgtatacgattttcatgatgcagttgcaggctattcttcctcctggaacaattcctgatgcttatgctaatggctccagtgaagaacaggcattcatacaaaatctagctctttttttcacttctttcttcaagaatcacatgcgcatattggaggcatctccagaaaatagagctgcattacttctgggccttgagtacctcattggaatttcatatgttgatgacacagaggtttttaaggtgtgtttggattactggaatgtgtttgttttagagctatttgaagcacacaatcaaatggagcctgcagcatctgtaaacatgatgggacttcaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataagattatgagggaaacactgatctacttgtctcatcttgatcatgaggatacagagcagcaaatgctgaagaaattgagtaagcaattaaatggagaagactggagttggaataacctcaatactctctgctgggcaatcggatcaatatctggttctatggtggaggaacaggaaaataggttcttggtaatggttattcgcgatttattaaatctctgtgaaatcacaaaggggaaggataataaagctgtgattgccagtaacatcatgtatgttgttggtcagtacccaagatttctcagggctcattggaagttcttgaaaacggtggttaacaaactatttgagttcatgcatgagatgcatcctggagttcaggatatggcgtgtgatacttttctgaaaattgttcagaaatgcaagcgcaaatttgtcacacaacaggtgggcgagaacgaaccatttgtttctgaactgttgtccagccttgccacgacaattggtgatcttgagccgcaccagattcatacgttttatgaatcggttggccacatgattcaagctgaatctgataacactaagagagatgaatacctcaaaagactgatgagcctccctaatcagaaatgggccgagataattggacaggcaagccaaagcattgatatcctgaagaaccaggatgttattagatctgttcttaacatcctgcagacaaacacaagtgttgctagctcacttggaccacactttttcccgcaaatttccctaatctttcttgacatgttgacagtttacagaatgtacagtgagcttgtatcaagcaccattgctgaagggggaccttttgcctcaaggacctcctttgtaaaactccttagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaaatacaaaggtgaaatgcttgaagacgtgcctcgcatatttgaggctgttttccagtgcactcttgagatgatcactaaaaactttgaagattacccggagcatcgcctcaaatttttctctttgcttcgtgcgattggcacccattgcttccaagcattaattcagctttcaagtcagcaattgaaacttgtgattgactctatcaactgggcatttagacatacagagagaaacatcgcagagactggtctcagtctattgctggaaattttaaagaactttcaggcctcaggattccaaaatcaattctacaaaacttattttttgaatattgaacaagagatctttgcagttctgacagacacattccacaagcctggtttcaagcttcatgttttggtgctgcagcacttattttgtgtggttgatggtctgacggagcctctctgggatgcatcctcagtaccataccaatatactgacaacgctatgtttgtccgagattacacaataaaacttttaggttcatcatttcccaacatgacacctactgaggttacaaaatttgttgatgggcttcttagttcaaaacatgaccttccaagcttcaaaaaccatattagggatttcctggtgcaatcaaaggagttctcggctcaggataataaggatttgtatgctgaagaggctgctgcacaaagagagagggagcgtcaacgaatgcttgccattccagggcttattgccccaagcgaattacaagatgagatggttgattcataattctgtgattcagccttgctaatccagttccatttcttgctttggcctccaaacctctggagccctcaacaccccattgcccaagttctcttccagggtggtgaaagaaggtgcctgctgtaattttattttcggttacctccacttggtgctgattgcgagatttctgctagtcaataggaaaggccaactcaattttgtcgcaagagctgttttggactgccattggtttgcagtatgagctgtcaggttaatgtgatgacagcagctcttgtgctcctgtattttgctaacattgctgcgtgtgcggggccatcatatagtatgatcacggtacaacattgtatcatgatttttagtttagtttatagatcggccgcattctgtattgtggacaagattcaggatagaaacttatattcgtagtgtactattttgtgaaatatgttctttttacattgcccgcatatgtgctgtttggt

SEQ ID NO: 3489 - DNA, 520 bp, Oryza sativa
aactccccaaccaagcagcggcgagccagcgatggcgacacccactgcccaaaccgcggcgctcctcgccgccgccgccgcgctcttcctcctcgcgtcggcggccctcccggtcgtccgctccgacgccggcggcgacggcgacgtcaccgcgtacgacgagctccggcaccgcgggttcccgctgggcttgctgccggcgaacgtgcgcgggtacacgctggactccgggtcgggggacttcgccgtggacctcgcctccagctgccggatcgtgctccccgcggggagctacctcgcctccttcagcgaccgcctcacgggccggctcgacgaccgccgcatctccggcctcagcggcatccgcgtcagggccttcttccggtggtggtccatcaccgggatccgcgccgacggcgacgagctcgtcttcgaggtcggctccgtctccgccaagttccccgcccgccacttcaacgccagcctcgagtgccccgccaaagccgactcttagtactaa

SEQ ID NO: 3490 - DNA, 302 bp, Oryza sativa
ctcgagtctccaaccttgcgaaggcgaagcccccgtgagatctccggccgccgccgccgccgccatggacgccgtcgactcggtggtcgacccgctgcgcgagttcgccaaggacagcgtccgcctcgtcaagcgctgccacaagcccgaccgcaaggagttcaccaaggtggcggcgaggacggcgatcgggttcgtcgtcatgggcttcgtcggcttcttcgtcaagctcatcttcatccccatcaacaacatcatcgtcggatccggctgatttgagcactaaggcaagaattcgcagg

SEQ ID NO: 3491 - DNA, 1000 bp, Oryza sativa
tgcttctcttctttcctctctgtcttctgtcttctcttcttcttcctcaccaaagttgttgagttggtgtcctgttcttggacggacaagggtgtttatccaaaagaaatccatcccgagatttgcttctcttgcgcgcacactggcaccgtccggatcgctgaatcttgctggtggtggtggtggtggtggtggtggtggtgcacggccatgtcgacggcggtggcggacgtgccaccggcggcggcctacgggttccccggatcggccaagagagggaagcctgaggaggtggtggtgctgatggggaagaggaggaacgaagggttcttcatcgaggaggaggaggaggaggaggaggtgctgacggagagctcgtcgatcggcgcgccgtcgccggcgagctcgtcgatcggggagaactccggcgaggaggagggaggggacgacgaggaggaggtggagagcaagctcaaggcggaggatgagcaggtcggcctcggctgcttggacgccttggaggaatccttacccatcaagagggggctctccaacttctacgccggcaagtccaagtcgttcaccagcctcgccgaggcgacggcgtcgccggcggcggcggccaacgagctggccaagccggagaaccccttcaacaagcgccgccgcatcctcgccacctggtcgcggcgagcctcctgcagctccctcgccaccgccacctacctcccacctctcctcgcgcccgaccacgccgtcgccgagggcgacgagggtgaggaggaagacgacgattcagacgacgatgagcggcagcaccgtggcaagaacggcggccggcgagagtcggcggcgccgccattgccattgccgccgccgaggctcaccttgcacacccagatgggaggaatggtgaggaggaatggaacattcaggtcgccgaggtcgctctcactgtctgatcttcagaacagtggcggttcatgttagtttgctgtga

SEQ ID NO: 3492 - DNA, 1060 bp, Oryza sativa
caagcggtaggagatgaggcccgcggtgagcagggccgccttcgcgtccgtgcttctggcgccgcgcgcggtcggggtcgccgcccgctgcgcctcctcctcctcttcggccgcctccccgtcggtcgccgccgccacttacgatcacgcgtcgtttattaaggaggtcgccgcaaccgatccaccggagcatcttagctcgttgctgaatgtgctccaggcacgaggtgaaaagctagtttctccaggggcgaaaagaggcctgattccacttgttgttcccttagcagaaagtccagcaggtaatttaacatcactactgagatggccaactgctcctagcgggatggaaatgcctgtggtggaagttcgtaatcacggcctatggcttttggctaagaatgtgaaccaatatattcacagagtgctcgttgaggctgatatcaatggttacgctgatgatttatggtctgctgtgggggacactggtaaaaaactttacacaaaaggtgatttcaaagagtcacagatggcagatcttgatgcctatttgttgaagaaggttggcctctttccagatgttatagagagaaaaacatcacgccatttcgaaaaaggagattatgtgtcagctctaattactggagaattctacactagagatcaatttcctggatttggaaggccctttgtgttcaacgcagagatattaaaaagagttgggcgtacaaccgaagccaaagattcagctcgagtggctctgaagtcaccatggtggacactgggctgcagttatgaagaggctgctgaattagctgggtgggaggatgagcagattgagtttatacgagagaaggttagtgaggagggcaagcgtgaggatctgaagaaaggaaaagctccagaacaggtggttcttgacgaggcagcatttctaatggatttggcatcggtggatggtaattgggacgatgttgttgatcgaattgctggatgttacagagaagctggacttgatgatattgcgaagttcattgcttaccgggaatagttgttataa

SEQ ID NO: 3493 - DNA, 1010 bp, Oryza sativa
ctcctcagatccaccaccaccgagcgcccgcgatgacggccaagggcggcgccgcgccgtcgccgggcggcgcgggcggcctcccgaacggccgcttcttcaccgtggggctcgtcaccgcctggtactcctccaacatcggcgtcctcctcctcaacaagtacctcctcagcaactacggcttcaagtacccaatcttcctcaccatgtgccacatgtccgcctgcgccctcctctcctacgccgccatcgcctggctccgcgtcgtccccatgcagctcgtccgctcccgcgtccagctcgccaagatcgccgccctcagcctcgtcttctgcggctccgtcgtctccggcaacgtctcgctccgctacctccccgtctccttcaaccaggccgtcggcgccaccacccccttcttcaccgccgtcttcgcctacatcatgaccgtcaagagggagtcctgggtcacctacctcaccctcgtccccgtcgtcaccggcgtcatgatcgccagcggaggagagcctagctttcatctgtttggattcatcatgtgcattggggccactgctgcaagggcattgaagacggtgttgcaaggaatcctcctttcatccgagggggagaagcttaattctatgaatttgcttttatacatggctccaattgctgttattctcttgctccctgctaccatcttcatggaggacaacgttgttggcattacaatagaactggccaaaaaggacaccacgattgtttggttgctgctgttcaattcctgtttggcatattttgtcaatttgaccaatttcttggtgactaagcatactagtgcattgactctacaggtcctaggtaacgcgaaaggtgctgtggcagttgttgtctcaattctaatattcaggaatcccgtatctgtaaccggaatgctcggttacactcttacagttataggcgtaattctttacagtgaatccaaaaaacgcaacaagccctgaatattttag

SEQ ID NO: 3494 - DNA, 539 bp, Oryza sativa
aggtacagtatagtatgacaccgaccgtcgcgaccaccaccccggccgccgcggcggcgacgacggcggcggcggccgaggtgaagccggcgaagcgctccgtcggcctcggcctccccgcgcttccgccattattgcccggcctcgcctcccacggccagccccgtgtcgcgtccttctgcaagaggctggcgaggaacgtggtggccatggcggcgggggaggcgccggcggcgccgctcgccgccaacgcggagatcaccgagttcatcaacgccctcaaacaagagtgggacaggattgaggacaagtacgcggtgacgacgctggcggtcgctgcgtcgctcgggatgtggagcgccggcggagttgtatcggcaattgacaggcttcctatcgttcctggtctcatggaagctgttggcattggctacagcgggtggtttgcataccggaacctgctgttcaagcctgacagggaagctttctttgcaaaggttagggaggtctacgaggatataatcagcggttaacagtag

SEQ ID NO: 3495 - DNA, 521 bp, Oryza sativa
aagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctctttga

SEQ ID NO: 3496 - DNA, 435 bp, Oryza sativa
tctctcaagatggtggtgctgcaaccagatccgtttctgagcgagttgacgagcatgtacgagcggagcacggagaagggatctgtctgggtcaccatgaagcgatcatcgatgaagtgccaggcaaggttgaagaagatggcggcgaagggagaggcagtggagtaccggtgcctcgtccgtgccaccgatggcaagaagaacatctgcaccgcgctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagccctt

SEQ ID NO: 3497 - DNA, 1008 bp, Oryza sativa
gtcgacgagagaagagagatggtcctccccgtcctcgcgcccctcgccggcgccaccgccgtcgccttcctcctcttcaagttcgccaccgtcgatggggatttcacgctggtctcgcgcggggcgccgcggcgggagaaggtggacgggaaggttgtgtggatcactggagccagccgcgggataggggaagttcttgcaatgcaatttgctagtttaggagcaaagctgatactatctgctcggaacaaggaggagcttgagagagtgaaacataacatcatcaacaagcatccaaatagcagagttgaagtattacccatggatttatcatcgggtgaagagtctctgaaagagcatgtacatgaagcagagtcactcttctccaatgcaggcgttgactatatgatccataatgcagcatttgagcgtccaaaaaggagggctctggaagaaactgaacaaggtcttaaggctacttttgatgtcaatgtctttggtactattactctaactcgccttcttgcaccctcaatgatggatagagggatgggccattttgttgtgatgagtagtgcagctggaaaggttccatcacctggccaggctctttattcagcctccaaacatgccctcaatggctatttttcttctctgcgctctgagttatgtacaaaaggcattaaggttactgttgtctgtcctgggccgatcgaagcaccccaatcttctggtgcaacctcttcatcacaaaaaccatcttctgagaaacgtgttccagttgaaagatgcgctgaactgacaattgttgcagcaactcacggactaaaagaagcatggatatcatatcagcctgtgctaggggttatgtacttggtgcaatacatgccgacggttggtctctggcttatggacaaggttggtgcaaagcggctggatgtagcagcaaagaaaggcaatgcgtacggttggaatctccttttcggtggcaagaagtcagcatgataa

SEQ ID NO: 3498 - DNA, 1617 bp, Oryza sativa
actccgaatccgacgcacccacacccatccactccagagctccccgcggcacttggcaccaccaccaccaccaccggcatccggcggcgcgggcggtgatggcgaccatcaccacgcagctccggtcggccctcctctcgccggcggcctcgccgagccgccgtgccaggcgcgccccgtcgtccgtgcggtgcgactcctcggcagcgtcgtccctgtccgcctccgcgtcgctcgacgccgacttcgacaagaagcagttccgccacaacctcacccgcagcgacaactacaaccgcaagggcttcggccacaagaaggagacgctcgagctcatgagccaggagtacaccagcgacgtgatcaagacgctcaaggagaacgggaaccagcacacgtggggccccgtgacggtgaagctggcggaggcgtacggcttctgctggggcgtcgagcgcgccgtgcagatcgcctacgaggcgcgcaagcagttccccgacgatcgcatctggctcaccaacgagatcatccacaaccccaccgtcaacaagcgattggaggacatgggcgtccaaaacattcctgttgatgcaggtattaaggatttcgatgttgtcgagcaaggggatgttgtcgtattgcctgcatttggagcggccgtggaggagatgtacacgctgaatgagaagaaggtgcagatagtcgatacaacgtgcccttgggtttcaaaggtgtggaacatggttgaaaagcacaagaagggtgactacacttctattattcatggaaaatactcccatgaagaaactgttgccactgcttcctttgcagggacatacatcattgttaagaacatagcagaggctagctatgtatgtgattatatacttggtggccaacttgatggttctagctccacaaaagaggagttccttgagaaattcaaaaatgctgtttctccaggatttgatcctgatgttgacttagtgaaagttggcattgccaatcaaacaacaatgcttaaaggagaaactgaagaaattgggaagcttgttgagaagacaatgatgcgtaggtttggagttgagaatgtcaatgaccacttcattgccttcaacactatctgtgatgccacacaggaaagacaagatgcaatgtaccagctagtgaaggagaaagttgatcttattctggttgttggaggatggaactccagtaacacctctcatttgcaagaaattggagaactcagtggaattccgtcttactggattgacagtgaacaaaggattggacctggaaacaagatcagctacaagttaaatcatggcgagcttgtcgagaaagagaactggttaccagaaggccctatcacaatcggagttacttctggcgcctcaactccggacaaggttgttgaggatgcgttacagaaggtgtttgagatcaagcgccaggaagttttgcaggccgcgtaaattttcatcaggtttggtcacggtagctgatggcttggtgaaggttaatagaaccagtgcacaagcgatgtctgtacagtagtgaagaatgctacgcttttaggagcgcatactacggcatgtgctgagatttacgtag

SEQ ID NO: 3499 - DNA, 354 bp, Oryza sativa
tctcgcagcacaaagatggacgcaaacagacgccaaagtggaatccagcaattgttggctgcagagcaagaggctcagcaaatagtaaatgctgctagggctgcaaaatcggcaaggcttaggcaagcaaaagaggaggctgagagggaaatagctgaataccgtgcccagatggaggctgaatttcagaggaaggttgcagagagtagcggtgactctggtgcaaatgtcaagcgtcttgagcaggagacagcggaaaaaatcgcacaactcaagcagcaggctgcaagtatctcccctgaagtgattcagatgcttctgaggcatgtcaccactgtgaagaactaagggtga

SEQ ID NO: 3500 - DNA, 846 bp, Oryza sativa
gtcgacttagcacacatggcgtcttcaacctcgagctcgctcgccgtggcaacaatggtggccgtcgtcctcctcctgggtgccaccacccaggcggcgcgcctcctcgacgaactcgtccccggcattccgatgccgacgatccccggtgtaccggcggtcggccccaccatcccggccatcccgacgatccccggcgttccggcggtcggccccaccatcccgaccatccccaccgttccgacgatccccggagttccggcggtcggtcccaccatcccggccatcccgacgatccccggcgtgccggcggtcggccccaccatcccgaccatcccgaccatcccgacgatccccggcgtgccggcggtcggttccaccattccgaccatcccgacgatccccggcgtgccggcggtcggcccgactatcccgaccatccccggcgtgccgacgatcccgacggtgccgggagtgccggagctgccggtaaatcccggaggcgtggtgccgacgatcccgaaggtgccattgccgccggtgaatcccggagccgtcgtgcccgccgtgccagctctgccggtgccgccgatccccggagccgcggggggtgtcgtgccgaccctgccggtgccgccgttgcccgccgtgccgggagtcccgctgccggaggtgcccggcgtccctctgccgccggtgccgtccgtcgtcccgcccgtgccttaggtcaactccggcgagccccgtgccgtcgttaattaattactccggccagctgacgtgtacgtggcattgaccgtgtgcgccatgcattggccgccggcgccggcagccatctacagatta

SEQ ID NO: 3501 - DNA, 2639 bp, Oryza sativa
tcatctctctccctctcatcgccatggccgcctcctcctccatttccatttgcatcaccacctcctcctcctcttctccgaaccctaattccgacgagcggtggtggtgctagcgagcgagcttgatctccatgcgtcggcgctagctccaccggcggccatgcctcaccgacgacgcctgcttaacccggcgccgtcactgccgccgccgccggctgctgctccggccggcttccaccaccacctcctcgccgtcgacgacacgcggctgccgctgctcgccgactacgcgctgctgcagggcgacgccgcggcggcgccggcgtccgcggagtggagcgccgggagcgggttcaccggcatctccaccgacccggccaccgccaccaccgccacgacggcgtccaccgccacggcgccgggatcggcgtcgaacctgacggcggcgaccgccggaggaggagggagggagacgtgggtccgccgcgccagggagggctactacctccagctctccctcgccatccgcctaacctccgaggccttcctcgccggcgtcccgcccgagctcctcatcggctgcggcggcggcggcgaagccgagaaccacgccgacgtcgcggccgatgccgccgctgtctcctaccggctctgggtgaacgggtgcttgtcgtggggggacaagatcgcgcacgggttctacaacatcctgggggtggacccgcacgtgtgggcgatgtgcaacgctgcggcggaggacggccggcggctgccgacgctggtggcgctccgggcggtggacagcggcgagtcgtcggtgctggaggtggtgctcgtcgacaagtgcggcgacccagcgctcgccgacctcgagcgccgggccctcgacctctaccgcgccgccggcgtctccctcgacctcgtccgccacctcgccgtcctcgtctccgaccacatggggggcgcgttgcggtcggaggacggggacctgttcatgcggtggaaggcggtgagcaagcagctgaggaagcggcacaggtgcgtcgtcgtccccatcggcagcctctccatcggcttctgccgccaccgcgccatcctcttcaagagcctcgccgacttcatcggccttccctgccggatcgcgcagggctgcaagtactgctccgcgccgcaccgctcgtcctgcctcgtcaagatcgacaacgagagaaggtttgtaagggagtacgtcgtcgacctcgtcgttgagccgggaagactcagcagtccagactcgtctatcaatggccagttgctctcctccgtgccttcacctttcaagacctcatgtacaatgagttctgcaaactatgcaacaccggctgcttcgtggaatcgcgcgatatctggagatcgtcgcaactcgatactgtcaaatcctcagtattcagttgctaagtactgtgttgccgaggagaagagctctgttcaggtagccaccaaagaagccatgctgccaaaatgcggtcagatcacgcagaacggcaactgcaacaagaacagtatggcagtgttcgaagtgtcgaagcagatgaaggcgatggagatcagttctgagagtggcgataaggacaacatctccagtgctacgcctctgaaacggctgagcatcgagccgtctttctgcgccgattggctcgagatttcatgggacgagatcgagctaaaggaacgcgtaggcgccggttcgtttggaactgtgtatcgtgctgactggcacggctctgatgttgcagtgaaggtgcttactgaccaggatgtcggcgaagctcaactgaaagaattccttagagagattgcaatcatgaagcgtgttcgccatccgaatgtggtgttattcatgggtgcagtgacaaaatgcccacatttgtcgatagtaacagagtatctgcccagagggagcctcttccgtctcatcaacaaggcatctgctggagaaatgctcgatttaaggcgtcgtttgcgcatggcgttagatgttgcgaaaggcatcaactatctccattgcctgaatcctccaattgtacattgggatttgaaaacgccaaacatgctggtggacaagaactggtccgtgaaggtaggtgactttggcttgtccagatttaaggcgaataccttcatatcctccaaatcagttgctggaacaccagaatggatggcaccagaatttcttcgtggcgagccatcaaacgaaaagtgcgacgtgtacagctttggagtgatcttatgggagctcatgacaatgcagcaaccatggaatggcctaagccctgcacaagtagtaggagcagttgcattccagaacagaaggctcccaattccacaagagacagtccctgagctagctgctcttgttgaatcctgctgggatgatgatccaaggcagcgaccgtcgttttcgagcatcgtggacacgctgaagaagttgctcaaatcgatgcttggtggctcatgacgaatactgaagactgttggtcgccttcttatttttgttctccctgttaatgttaatctacagcaaacaataagttggtaagtcagttgccttaaaggcatctgagttctctacagaaaggagaggatagttgaagcagcac

SEQ ID NO: 3502 - DNA, 699 bp, Oryza sativa
tcttctctttctcttctcctcgcgactccgccgctgctcgagagcgcaatggcgtccatggcgttcacactggtgggagcattcaaggggatgtccctctcctccccgtgccattcctcctcctccgcctccttcctccgcgctgaccgtgtctcgctctccgtcggcggcggggtcgggatgggggtgccgatgacgatgccggtgcggcggctgacgatccagatggcgcacaagaagggggccgggagcaccaagaacgggagggactcccccgggcagcgcctcggtgtcaagatttacggcgaccaggtcgccaagcccggcgccatcatcatccgccagcgcggcaccagggtctatcctggaaataatgttggaatgggcaaggatcacaccctcttttctttgatcgatggcctcgtaaagttcgagaaatatggaccagacaagaaaaaggtaagtgtttacccatacgagaaacaacctgagaacccaaacagttacagagcaagaaagagagagtacttccgcatgcagcgtgaacgcaaaaaggcaagagcagagggaattgttgaggtgcaattggtgttggcagctgcagatgaaagtcctgaggtcaatgcagactgctgataagttctctgccccgtttttctccattttcgcaatccatgtttgataacaatgtttggaatg

SEQ ID NO: 3503 - DNA, 1054 bp, Hordeum vulgare
ttgctccctctctctctcttggccgatcaagcgcgtttctttgctgctgcttcttcggcggtcttgttggcgatgggggccgggatggtggaggtggagctggggccagggatgggggcggcggagtccgtgccgccggccaagaggaggcgggtggtggccctaaagaccgcggcttcggcggcgggaaggaggccgcggcgcgccaggaggccgtccgccatccagcggctcttccaggcctgccgcgccgtcttccgtggccccggcaccgtgcccgcccccgccgaggtcgccctgctccgcgccatgctcgacagaatgagaccggaggacgtcggcctaagctcggaaatggccttcttcaggaacagggacgccgcagccgaagggaccccgacgatcacgcacaccaccatatacaagtctgagaaattctccatggttctcttcttcttgccgacgaatgcggtcatccccctgcacaaccaccccggtatgacggtgttcaacaagctgctcatcgggtcgatgcatgcaacgtcatacgactgggctgatcccgacgatgatccggctaatgagagcggcgcctcgtcggctgacgctcaattgaggctggcacaactggtcgtggacgatgttttcacggcgccgtgcgacacgtcggtcctgttcccgacggcgggaggcaacatgcaccggttcagggccgtcgcgccatccgcgttcctcgacatcctcggccccccttactccatcgaagaggaccgagactgcacgtactacacggacattccatactcccagcatcgcatgaccggcggtgagctcggcggggacgagcaagaaggccggcgtctcgcgtggctgaaagaggtggagatgccgagggatctgaagatgtgcagcgtccggtacggcggcccaccgatctccggcaggtgatcgatgatcctttccttccagcccttttgcgaccgatgatgagctgtcaagcgtcaacccaactcaaaccagatggtttcagaatcgttgtttacctcgtgaataa

SEQ ID NO: 3504 - DNA, 839 bp, Oryza sativa
cctccatccttcagtaattggcctccaaacacagagcccgaatgagcatggcaagggagcactttgtgcttgttcatggagaagggcatggatcctggtgttggttcaagcttcgttggctccttgagagctctggttaccaagtaacatgcatagaccttgctggagctggtgttgaccctaccgaccccaacacagttcgatcatttgagcagtatgacaagccgctcctggacctcatctcagccataccagaggatgagaaggtgattttggttggacatggttcaggagggttgagtcttattcatgcaatgcaccaattcgttgacaggattagacaagcaatttttgtggcagctacgatgctaccatttggacttcaaactgacgaagataagaaagatggtttaccaacattgcctgagaatgagatcaatttgatattcggcacaggagcagatgatcctccaacaactgctgccctgagaccagaattccagagagagagattatcccaacagagtcctgaagaggaatcagtactcgcttcaatgctgatgcgtccatggcctgtgacagctattagcactgcaagctttgaaggagatgatgagagactaaatcgaatcaaacgggttttcataaagacagaacgtgaccatatgctgaaccctcagcagcaagattccatgatcaagaagtggccacccagtgaggttttggaaatagatacagatcatagcccctttttttcagcaccagaacagctctttaatctaatagtcaaatccctatgatgtaaatctgcatacaactcaaacatccaaggagactga

SEQ ID NO: 3505 - DNA, 2475 bp, Oryza sativa
actcccaacgtctactcttcccccaaatccctcctccccatcgcggcgctgccgccgctcctcctccggcagccagccatggccacggtcacgccgggggtgctgctcaagctgctgcaggcgatgcacaccgacgaccgcgtcgccggcgaccaccgctcccccgtcctccaggtcacggccgtagtccccgccctcaccgcctccaccgccgactccctctggccctccaacggcttcctcctccagctctccgacggcctccactccacctacgtccagccatcctccgccgacgccgacgccctcgtctccgcgcgcccgcaactcgtcggccacctcgtccacctcgaccgcctccgcttcgcccgcccggtgccccgcgccgtcgggatccgccccgtcccgtcctcccgcagcgtctccttcgtaggaaacccggagccgctcgtcgcccgccccgccgcgtgctcccgcggctacgtcatccagcccgggtcccactccgactccgcgccgccgctcatgccatccagttccggcaatgcggtgcagtccgatgcaacggatgccgtcaagaggattgttctcgcgcccaagagcgtctccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcttcccgagcgtcctcacctgcggtcaggggcacgcccagggcgacgtcaccagcgccttccaaatgcgtggtgcccagccttgtttcggccaaggaggagaatcgccgcacggcgagggagccagcgattatcgtgccatcgaggtacaggcagccgtcaccggtaggagggaggagaggggcggcgtcgcccgcacccggtgggaggcgcgcgtcactgtctcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggaagccactgaacgaagagacgcagcagcaattgctgcagctgatgctctccaggaggcattaatcactgaatccgtaatcaggaacctaagtaaattttctgaacttacttcagcatcgaagacctccaatccccttccaacagttgatatcttccttgctgtctatgaggatactctcaaatggaagaaaattgctgagtctatatccaccaatagaactgaaactgcatcatgggagaattcagctactcattgggttgaagcagcattggcaactgatcttgaagtcctaaagttgatgaataaggcacctgaatcgctctctcggaaaaggggtgctgataagccaaaggctccctcggtggtagaagctccaagaacaaccatatccaagaggcaatcacatgggacttctgcaaaggtccagtcaaaggtcttaccgacctctacagcgagctgcgcatggaacaaaactcagggcgtgaatgagacggctgagcttgccacgaccttgtgccgtgagatgcatacgtggttcctgaaatttgtggacgaggcaatggatttgggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttacgggttcgtcatcaatcacatgggatctgcatttgatagctcggtctcgatttcatcaaggaattgaggaatgcttaaagtaagcctttaagtttcttctcttttatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttagagctacaagatttcattcttacat

SEQ ID NO: 3506 - DNA, 809 bp, Oryza sativa
tgtcaatggccgccgccgccgccgatcccctcgtcgccggcgccaccgtctcctccgactccgactccgactccgacgatctccacctcctcctcccgaatctcctcccttccgccgccaccgccgcatcagacgcgcagctccaccacttccacctccccgcgctcccgtcccctatcaccgtccgcaccctcccttccctcggcctcaccttccagctctggccatcggcctccaccctcctccgcgtgctccccgcctcgccgctcctcctctcgcgcgcgcccaccccggagagcccgctgggcatcctcgagctcggctccggcaccggcgccgcgggcctcgccctggccgcggcgctgcccgcccacgccgtcctctcggatctccccgcggcgctccccaacctccgccacaacgcgtccctcaacgcgcccctcctcgacgcccgcggcggctccgtctccgtcgtcccgctcccgtggggcgacgccgccgcgatggaggccgtcgctgctccgccgccggcttctcggttcgacctcgtcgtggcgtcggacgtggtgtactacgaggcgttggttgaccccttgattgagacgatgcggttcttcgtcaagggggaggtggtgttcgtgatggcgcacatgagaaggtggaagcgcacggacaagaagttcttcgccaaggcgaggaagctgttcgacgtcgaggtggtacacgaggacccgccgctcgaagggtggcgccatggcccggtggtctacctctttaccgagaagaagcggcgtgacaagaagtgatga

SEQ ID NO: 3507 - DNA, 666 bp, Oryza sativa
gagataattagctcactccatggccgctgctcggtttcctctccttgtcctctgcctcctgccgatcatcgtctgcagcgtcgtggacgcggagctgacccatctccacttctacttccacgaggtcgacgccggcacgcccaacgccaccgtcgtcaacgtcgccagccttcaccggaactcgtcgacgttcggcgacgtgaacgtgttcgacaacgcgctgcgggaggggccggacccggcgtcgcggctgatcgggagggcgcacggcctcgcggtgcacgcgtcgctggacgagacgggcggcctcacggccatcaacttcgtcttctccgactacggcgcgtacagcggcagcacgctggccacgcagggccacttcatcacgacgggcccgtcggagcggagcatcgtcggcggcacgggcaagctccggttcgcgcgcgggtacatgaccagcaagcttctcagctccacggacaccgccatcgtcgtcgtcttcgacatgtacttcaccctcgaccattgaatactactccgtggtgtgttatatatcgtgcagtgcttgctttggtgttcggttgaacatatgtatgcacggcgatcgtgacgaatactggggttcggagaattcttttccgacccatcgtctcataggcccaattc

SEQ ID NO: 3508 - DNA, 721 bp, Oryza sativa
aacacctctctggctctctcccccaccgcgtcgtcgtcgtcgtcgtcgccgatggccaaatgcagcaagatccgctacatcgtctggctccggcagacgctgcggcggtggcggtcccgggccgcggcgcgcgcggcggcggaggcggtgccggcggggcacgtggcggtgtgcgtgggcggggcgtcgcggcggttcgtggtgcgggcggcgcacctgaaccacccggtgttcagggagctgctccggcaggcggaggaggagtacggcttcccgtcgggcgcctactgtggccccatcgcgctcccctgcgacgagggcctcttcgagcacgtcctccggcacctctcctcgccgtcctccgccgcgcggttcgtcaccctcgaggacatccagagcggcgccctctcctgctgctgcgccgccgccggcgacgccctcccgctcctccgcggcattgccaccgacaaggccgtgtggtgaatgcgatgtgtgatcccacccctagctagccgctccgctcgccattgcgcgtgcgtgcatgcgcgcgaccgttcttgccaccattttttttttctcttctcttcttgtcctcttttttcccctctccctccatggccatttgagaggagctgagactcgccggagcaagagaaagagagagaaatcggcggccggccggcggtggcggtgaagtgagatggctgagaaagtcttagga

SEQ ID NO: 3509 - DNA, 1481 bp, Oryza sativa
ggtccatggagcctcacgtcctcctcgtgtccttccctatgcagggccacgtcaacccgctcctccgcctcggccgccgcctcgccgccacgggcctcctcgtcaccttcaccaccgtccgcctcgccgccggcggcggccgcctccgcgacgtgccggaggacggcgcgtgcgccgacgtcgggctcggccgcctgcgcttcgagtacctgcgcgacgacgacgacgacggcgacgagcggtgccagcagctggcgcccaacgacgtgctgtcgcacgtcacggccgtggggccatcggcgctcgccgagttcatcgacggccaggccgacgccggccggccggtgacgttcgtcgtgaacaacatcttcgtgccgtgggcgctcgacgtcgccgccgggatgggcatcccgtgcgccatgctgtggatccagccgtgctccgtgctgtcgatatactaccacttctacgagtcgcccgaggcgttccctaccgccgccgaccccgacgtgccggtcgagctccccggcttgccggtgatggccatggtcgagctgcctttcatggttcgtcccgagtacgcgcagtgcctgtggggcgacacgctccgggcgcaggtcggggcgatcaagaggacggtgtcctgggtgctcgtcaactcgttctacgagctcgagcgctcggccgtcgacgcgctccgcgcgcacacgacggtcaagctcgcgcccatcggccctctcctggagcatggccatgacaacggcggcggcgacgacggcgcgccggcgccggcgctaggggccgaggacaacgaccgctgcgtggcgtggctcgacgcgcagccgccgcgctccgtggtgtacgtggcgttcggcagcctcgtgaacatcggccgcgacgagacggcggcggtggcggaggggctcgtcgccaccggcaggccgttcctgtgggtggtgcgcgacgacagccgcgacctcgtgccggaggccgtcctcgcggcgtgccgcggcgacaaggccggcaagatcacggcgtggtgcccgcaggggcgcgtgctcgcccacggcgccgtcggctgcttcgtgacgcactgcgggtggaactccatcatggaggcgctcgccgcgggcgtgccggtggtcgggtacccgtggtggtccgaccagttcgcgaacgccaagttcttggtggaggactacaaggtcggcgtccggctaccggcgccggtgaccggcggcgagctccgagcgtgcgtcgaccgcgtgatgagcgggccggaggcggcggtgatccggaagagggcgatgcattggaagcgagaagcggcggcggcggttgccgacggcggttcgtcggatcggagcctccaggattttgtcgaccatgtacgacgttccaaaggaccggaggagctagctcgattagctcaagacatccagattatgaatgggccggtcaatccggtcctagtttaataa

SEQ ID NO: 3510 - DNA, 618 bp, Oryza sativa
aaagttagcgaccaagaaaccgcagaaatggaggagcagcagcatctgcatcccggcggcggcggcggcaagaagtcgaacaagatcaccgagatcgtgcggcttcagcagatgctcaagaagtggcgcaagctctccgtcgcgccgaaagacgcggccgccaccgccggcaatggcggcggcggcgagagcaaggcgaagaagttcctgaagaggacgctgtcgttcacggacggcggcgcgtcgccgggggggacgccgccgccgagggggcacctggcggtgtgcgtggggccgacggcgcagcggttcgtgatcccgacggactacctgaagcaccgggcgttcgcggcgctgctccgggaggcggaggaggagttcgggttccagcaggagggcgtgctccgcatcccctgcgaggtgcccgccttcgaggccatcctcaaggccgtcgagaagaacaagaaggacaacgccgccgccttctgctactgcagctacgagtacgccgccgacgaggtcgccctcggcgcccccaacaacccattgtgcagatgaagagaacgtagtagctgctggtttttagcatggctgttgttcatccatccaaaagaaatg

SEQ ID NO: 3511 - DNA, 1283 bp, Hordeum vulgare
ccacaatgtgggacgaaaatgaagagactgatgacgagcatgggcacgatgacgacgatgttccctccgggagttccgaggaaggggagcccaagttcatagaagacaagtacaggtacagcacggtggatgaggtcattactgtactgagagaagctgggcttggatcatcaaatcttatttttggcattgacttcaccaagagcaacgattggtcaggtaagcattccttcggaggagaatctctgcatgccatcagtcgcaccccaaatccttatgagcaagccatttctattattgggcgaacactatcaccttttgatgatgataacttgataccatgctttggatttggtgatgtttctacatgtgatcattccgtcttcaacttttacgaagaagaccgtccttgtcgtggttttgaggaggttcttgatagatacaaacaaatgattccatatttggacttttcaggaccaacttcttttgcaccccttatctacgcggcgatttcagtcgtcgaaaggagtaacttccaataccatgtcctcgtcatcatagctgatggacaggcggccacctcaaagtcttacagcatcttaagtccacaagaagaggaaactatacaagcacttgttgatgctagcttctatcctctttcaattgtgatggtgggagtgggcgatggaccatgggatgaaatgaagcatgttgatgactgtattcctgacagggcttttcacaatttccagtttgtgaactttactgacatcatgtcaacgagcaaggatatggagaagaaggaggctgcattggcctttgcagctctgatggaaatacccgctcaatacaaagcgacccaatgcctccaacctccagagtggcacgaagaaatggctgacccttggatgatccttccgccaccaattgaagtccttgaacgtgattatgctgttgcagtttcccattttccagccgcacccgccctgtctaccggcattggcaaggacagttcggatgaacaggtatgccccatctgcttaatgaatccaaaggacatggctttccaatgtggtcatctgctaagtctccctagcgcggcattaaccggcgttggcaagggcacttcggatgaacagttatgccccatctgcttaacgaatccaaaggacatggctttccaatgtggtcatctgacatgcaaggagtgtggtccgacgctatcgacctgccacctgtgccgcgcaccgatcaccgtgcgcctgaggctcttctcgtgatga

SEQ ID NO: 3512 - DNA, 462 bp, Oryza sativa
ctcgagagctcaatgattcgattcagaggttgaccatggtgtccacgatgtacaaggaggcggccgccacttgcggcgacggggagcactactcgcggctcatccgggagctgtgcgcgctgctcgccgccatcatctccccctcctcctcctcctccaccgcggcggcggcgaggtctccggggatgtcgcccgcggcggcggcgacgatgctgctcggcgcgtcggtggcgctgatgctgtgcgggtcggtgacgttcgcgatcgggctcctcctcatgccgtgggtcgccggcgtcgcgctgctgttcggcctctccgccgccgtctccaccctctcctccggcgtcttcggcaaggccgccgccgccgcctcttctccggtgagccacgcttcttcggataataagcctgtattagtggtagcttaggagattgatcattagcctttaattggttggt

SEQ ID NO: 3513 - DNA, 1570 bp, Oryza sativa
gattggttgcttgggtttggagagtaatgatggggtcgaggcgatccaggcgcgtttcatgggcctccggaggcaatctctgcaaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatatagtattggagcaggattggcatattgttgctggagaagaaagtagggagattgaaattcaaaatgagagaataaatggagcgcttgaggcaatttacccacgtccatcgaacattccgccaaacccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaaaagatcatcagaagcaaaagggatcaaaaaggataaaattagacaacacaatgggcggtcgaaattgagctgaagccgccatttaatttttgactgttctttggttcatctatcatggatcagtaaatattactccgttagctcttccattagcctccttttttatgttcgtcgaggagaggagatgttctgaaagaaagca

SEQ ID NO: 3514 - DNA, 1896 bp, Oryza sativa
aacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctcccgtcgcctccgccaccgccaccatcgccgccgccgccgtctcctccaccgccgtcaccctctcctccaccaccttcacctcctcctccatctccaccaccaccatctccatcgcctcctccaccttctcccccgccgccgtctcctccaccaccatcgccatcgccgcctccaccatctccaccgcctccatctcctcctccgccatcgccagtgtactacagctcgccgccgccgccgtactacgaggtttcaccggaggacaggtacctctcgccgccgccacctccggcgtaccacgaggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgtga

SEQ ID NO: 3515 - DNA, 441 bp, Oryza sativa
tcagtgttcttccattctttccagagagacaaagtaattgaccatggcaaaagatcctcatgtctccatctctctcaccggcctcgccatggtcgtcttcctcatcttcagctcctccttcctccaggccgcccaaggaccagacaagaagatggtgatgaagtacgacgtgccggtgaagaggttgatgtaccggccggcggcgatcggcacggaggcggcggcgtacgagccgttcgagctgtgcatgggctgccggtgctgcgcgtcgtcgaacgcgagcagctgcgtggacacccggtgctgctacgccatcgactgcaacatccccggcaagcccttcggcgtctgcgccttctccccccacacctgcgactgtggcgccaccaattgcaccagccagcagccatgaccacacacctcttgctgctgctaattcaa

SEQ ID NO: 3516 - DNA, 1481 bp, Oryza sativa
cgaactaactaaccatctcatcctcgaggtatccggccaagccgccaccggggtcaccaccatcgagctcgtatggagcggagggcgcagccggtgtcggcggcggtggcgccggtgacggggaggaggaagggtgcggcggcgagccggaagtggatggtggtgccggcggtgggggaggagcggagggtggagtttgggaagcaccagatcatgaagatgacggggctccccgggcgcgacctccgggtgctcgacccggtcctctcctacccgtccaccatcctcggccgcgaccgcgccatcgtcgtcaggctccagggcgtcaaggccatcatcaccgccaccgaggtgctcgtccccgaccacgacgacgtcctcctcgcctccttcctcctcgacctccgctcccgcctctccctcccggatgcggcgcctagcacgaatccggcggcggctgatcgcgggaacgggacggagcagggcgatcaggggagcgtgccaggtctggcgatcagcggtgctggcaacgccaagatcccgccctttgagttcaaggtgctcgaggtctgcctcgagcacgcatgcaaagacttggaatctcagacacgctctctggagaaggaggcgtatccggccttggacaagctgggatcgaaggttagcacgctgaacctggatcacgtcaggaatctgaagagccgcatggttgatctctcagggcgcgtgcagaagattagggatgagctggagcacttgctggatgacgacatggacatgtccgagatgtacctgacgaggaagctgtcgttccaagggctcagcggatcgctgagcagagcggattcacacaagtacgcatctgttgatcatgacgacgatagggaggaggaagaccatgacgatgagacagagagtggccgtgaaagttctgtttatgttaagcctgatatagaagagttggaaatgcttctggaagcttactttgtgcagatcgatggaacgctgaataccctgtaccatatccgtgaatacgcggacgacacggaggattacatcaacataatgctggacgagaagcagaaccagctgctgcagatgggcgtgatgctgacgacggcgacggtggtggtcaccgcgggcatcgtggtggtgagcctgttcggcatgaacatccacatcgacctgatgaaagacccggagacccccgagatggtgaggatgtccaacatgcacttttgggagaccaccttcggcacggtcgccggctgcatcgccatatacctcctggcgatctacgctgggaggaagagcaagatcctgcagtgatgcttcccaacagaggaagctaagcgtcaggttgcgagttctgcagcctggctgcgattttgctgggcagtggcgtagttgataggttgtgtatggatgtgatgcatttttgttgatttcgtatggtgtgggagcaataataatcgaacgat

SEQ ID NO: 3517 - DNA, 957 bp, Hordeum vulgare
aattcacctcccaagcagagcagcgcagcggcggaggggaggacgcagaaccgggaaggggaaatggcggaatcgaactcgtacgaggagcagcgccggaggcagatcgaggagaaccgccggaagctggaggagctgcgggtgcaccacctctccgccgccgtccgcgaggccgccgccaggcccaagcccaagcccaagcccaagccgaagcccaaggccccggagcccggcgagctccggcgatccggccgcgtcgccagcctcccggagcagcccaactacctcaacgacgcagagcagcgcgactaccgtggagtgtacgaggcatacgctgttcggaaagggccgaccgacgagcagagggccggtgccatcgccaaggccgaggaactccggcgccggatccaccgctcccgctgccccgccttcgtcaagcccatgtcccacagcctcgccatcaatgaagtccacatgcgagtcccgagggacttccgcaagtatctcccggcggcgcatggtgaggcggtcgtggtggtggatgaggcggatgatgagttccacatgatgtataatgcctacaaaaagcgctgccactatctcgaaaaggggtggaaagggttcgccttcgaccatgaccttgtcgatggcgattgcttggtcttccacatgacagagagggcaaaattcaaggtctacatttttagagcaaacccagactataaaagtgaccaaacttctgatgaatctgaggatgaagagtaatgaagatgtgtgcttccaatacattgttcggtcatagcagtttgtaggagaaacacgctcttggctgatgttggagttgcctaccgcgattgcatgctgattgcgtgtagagtcgcattctctgacccagtgtagcaggcctacattataacataggttagatgggagtagtaggtagtgcaggccttgtat

SEQ ID NO: 3518 - DNA, 699 bp, Hordeum vulgare
aaacccgataagaaaatggcggcttgtgctgcgcccccctacgtccgcatctcctgctccacaccttcaccgaccgctctccgccggccacgccgccggcgcgtcccctccgcccgatgctccctcgccgcggcccccggcctccgggcgccgccggagctcgtcgactccatcctctccaaggtgagggggactgaccggggcgtgctgctgccggaggaaggccaccaggaggtcgccgacgtcgcgcagcagctcggcaagtactgcatcgacgagcccgtcaagtccccgcttatattcggagactgggaggtggtgtattgctcggtggcgacgtccccaggaggtatttaccggacccctctcggccggctggtgttcaagaccgacgacatggttcaggtggtggaagcccccgacatcgtcaggaacaaggtctccttctccatctttggccttgatggcgccgtgtctttgaaaggcaagctgaatgtattagacagtaagtggattcaggtcatatttgagcccccggaactgaaggtaggctccttgggtttccgatacgggggcgagagcgaagtcaagctggaaatcacctatgtcgacgagaagatcaggctcgggaaaggatcccgaggctcgcttttcgtcttcctaagacaagattagaaggttaggcacgtatggcactag

SEQ ID NO: 3519 - DNA, 419 bp, Zea mays
atcctctctttccactcctagctagctaacatatatccacacatggcggccagttccaaggtcgtgtgcgcatgcattctcatcgttctcgtcatctcaagccacgccgacgcgaggcggctggtggcggcgacgtgcaacggaggaacggaaggaggagcatgcaagggtggcatcttcgtccaaggatatgcaggcctcagtgcaaggcagaaaatggcggccagtgcaacgagcactgagcaggtcgtcgtcgtcggcgaaggcatgccggcgaccaccacggactcccggcctacggctcccggcaacagccccggtattggcaacaaagggaagatcaacaactagtttaattgccgtgtgtgtgttcttgtatgcgttcttatctaataagcatccaattaagctgagtgcta

SEQ ID NO: 3520 - DNA, 570 bp, Hordeum vulgare
ctcgcttgcccactccttccccgaccgacggagccgatggcgacgctgcagctgaaccacatcgcgcgggagaccggcgacgtgcgccgcctcgccgccttctacgaggaggtgctgggcttcgagcgcgtcccgtcccacgcctactccggcttccaggttgcctggctccgcctcccggcctcccccgacgtcgcgctccacatcatcgagcgcgacccctccgtcgcctccccgggggccgagggcgtcccgccttcgcagctgccccggcggcaccacctggccttctccgtggccgacttcgacgggttcctcaccgggctcaggacccgcggcaccgagctgttcgagaagacccagcccgacggcctcacgcgccaggtcttcttcttcgaccccgacggcaatggcctagaagttacaagctcgagccctggcgataagtaacctgggacagggagcacgaaacagtttctacttctgcgacatccatgtagtgatgcccacctcgaggctgagacgatggaagctgcagaatctgagagtaaacatccaggatcatgctag

SEQ ID NO: 3521 - DNA, 1961 bp, Oryza sativa
accactaggactcaacgagaaggggggcaggtgtccgaagcggatcacggcggcgggagagagatccggtggcccgatccatggctgcggcggcggtggcgcgccgcgtcgtcctggtgctcgtcctcgccgccgcctccctcgccgcggcgccgcgcggggcggccgctcgctcgctcggcggcagggagggccccggggaggtcgacgccgacgccgccgtcgacctcaacgccaccaacttcgacgccttcctcaaggcctcgctggagccctgggccgtcgtcgagttcttcgcccactggtgtccagcttgcagaaactacaagcctcattatgagaaggttgcaaaactattcaatggtcgggacgctgcacatccagggttaatactgatggctagggttgattgtgcatcaaaggtgaacatcgatctttgcaatagattctcagttgaccattaccctttcctactttggggtccaccaacaaaatttgcttctgctaagtgggatcccaagcaagagaataatgaaataaagttaattgatgatggaagaacagcagaacgtttactgaagtggataaataatcagatgaaaagctctttcagtttagaagacaaaaagtacgagaatgaaaatatgcttccaaagaatgcttcggatcctgagcagattgttcaagcaatttacgatgttgaggaagcaacagctcaagcgttacagataattttggagcgcaagacgatcaaaccaaagaatcgtgattcgctcatcagatttttacaaattttggtggctcgtcacccatccaagaggtgccgaaggggatctgctgagctacttattaacttcgatgatcactggtcatcgaatctgtcgttaagttcacaagagggttctaaattgttggaaagtgttgcggaagagaaccactggatctgtggaaaagaggtgccacgtggatattggctgttctgccgcggcagtaaaagtgaaacaagaggatttagctgtggtctatgggttttgatgcattcactaaccgtccgaattggggatggagagagccagtcaacctttacatcaatatgtgattttattcacaacttcttcatctgtgaggaatgccgcaagcacttttatgaaatgtgttcaagcgtgtcagcccccttcagaactgctcgtgagctcagtctctggttatggagcacacataacaaagtcaatatgagattgatgaaagaagaaaaggatatgggaactggtgatcccttgtttccgaaggttacctggcctccaaatcagctctgcccatcttgctaccgctcaagcaaggtcaccgatggagctgtggactggaacgaggatgcagtgtatcaattcttggttaactactatggaaagaagcttgtatcatcctacaaggagacctacatggagtctcttcagcaacaagagaagaagatagtttcagaggattcatcgatttctaatgctgcaagcgtcccaattggagctgccctgggtgttgcgattgccagctgtacatttggggcgctggcttgcttctggagggcccagcagaagaacagaaagtactcacaccatttacgctctttaaagaaaatatgattaggaaaaaacattttaggcaaagaaagaactggaactgaaaaatagcctaccagttgctcaccctgcacttcatcagaggggctcatcaatgaatgtgtatttttctggacggattaaaatcttggtaagtgctccaaacagtgtgggaaaggaaatggtcgggcagtcagttacagatgaaaaactcacagaagtacgatgattaactcaagtgtattttttgtgcaacgatgtgagctttgttgcatcatgtcatagatcaacgtgtaatagtttgacatatagatttcggatgattggtgtatacgttcggatgttact

SEQ ID NO: 3522 - DNA, 759 bp, Zea mays
aagcctgttctctgtcgattgaggtcgctagacggcggcaatggagggaagaagggcggccgtgtcgttggtggcagcagtgtcgctgctgctggcgtgctcgcgatccccattcccggtcgtcgccgctgatgagggcgagacgtcggtgggggccccggacacgaaccagctgtgcgtgagcaagtgcgggacgtgcccgacgatctgcacggcgtcgccgccgacgatcctgccgatgacagcgccgccgccgccggcccttgcgctgctgccgctgtccgcgcccccgccgccgtacctgcaactggtgctgccgccgccgccaacgggggacgtgtacgacctgctgcctccggtgacgcctctcacgagcccgccggagtccccgtgcacgaccccgccttcgtcctcatcgtcgtcgacggagcctccgccgtcgccaccctcctcctcctcgccgccgccgccgccgccgccgaagagcggcggcgacggtggcagtggctcgtcctcgcacttctcgtccccgccgtcgtcgtcaaacccttactactacctgtacctctccggcggcgccagggcccgcggcggcgcgtccagcagcgcttgcgcggcgctcgtcctcgccgcgttcctgctcgccgtcgccctcttcaagtgacgcgcgctctgttggttactagttactactgccaatctgccatccatcagtcggctgtccagaccggccggggcgtaaagactaggacatgcatt

SEQ ID NO: 3523 - DNA, 1180 bp, Zea mays
aacatttacgcgatccattgcattgcgacttgcagctgcagagccggtgatggcggaccggcggagcaatggtggttcgccccctagctggagcttcgcgtctcaaagcagccactaccacttggcggcgatgagaggaagctacgcgccacagagcctctggcgcccgtcgccgatgccggtccgtggtgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacaccaacgtcatccgctacttccccacgcaggccctcaacttcgcgttcaaggactacttcaagggcctcttcaacttcaacaaggacagggacggctactggaagtggttcgcggggaacatcgcctccggcagcgccgccggggccacgtcgctgctcttcgtctactccctcgactacgccaggacgcgcctcaccagcgactacagggcggcggctaagggcggcgagaggcagttcactggcctcgtcgacgtgtaccggaagacgctccggtccgacggcgtcgtggggctctaccgcgggttcaacgtctccgtggccgggatcgtcgtgtatcgcggcctctacttcggcatgtacgactccttgaagccggtgctgctgacggagaagttgcagggcaacttcttcgcgagcctggcgctcggctggatgatcaccaatggcgccagtctggcctcttacccgctggacactatccggagaaggatgatgatgacctcgggggaggccgtcaagtacaagagctccatggacgccttcgcccagatcgtcaggaacgagggccccaagtcgctcttcaaaggcgccggcgccaacgtcctacgcgccatcgccggcgctggcgcgcttgccggctacgaccagctgcagctcatcttcttcggcaagaagtacggctcagggggcgcgtgaacagggacaagtttcagcgaattcagttga

SEQ ID NO: 3524 - DNA, 1119 bp, Hordeum vulgare
gagacgcaagaaacatagctccctcgaccaccggcgatggtgtggacgacggtgcaagagctggcggcggccgtcgaggagccaccgcgacagtacctggtgcacgaacaagaccaaggcctgctggccgctgaccagatgccggagcccatccctctcatcgatctcagccggctgacggccgacgacgaagccgacaagctccgggcggctctacagacctggggccttttcctgctcaccaaccatggaatcgaggagtcgctaatggatgccatgatgggtgcgtcgagagacttcttccggcaaccgtcggaagagaagcagaaatgcagcaacttggtagaccacggcaagaaatctgagctcgaagggtatggaaatgacaaggtggtaaaccaggatgagggcctcagctggaacgaccggctgcatctgcgactggagccagaagacgagaggaatttcaccaagtggcccactcacccggcatctttcagggatgtgctgcttgagtatgcatcaagaaccaagagaataagagacctcgtctttcgatcgatagccaagatcctggaccttgacgaggattactttctcaaccaaatatcaaacaaggatcccgggttcgcaagattcaactactaccctccgtgtccacgacctgacctcgtgttgggcatgaggccgcactccgatggcggtctccttaccatcgtttttgtcgaccacgacgtcggtggcttgcaagttgagagagacgggaaatggtacaatgttccagccaagccttattcgttggtgatcaacttggctgactgcatggagataatgtgcaacggaatcttcaggagcccggttcacagggtggtgacgaatgccgagaaagagaggctttcactggctgtgttttatgctgtggatggagaaacgatgctggagccagcgcctggtttgctggatgacaggcgaccgccaagatatgggaaattcaaggccaaggatttcggtctttctttggactgaacatttccatcaaagaaagaggttcactgagaacctgaaaatacaaatttgatggttttagttagtttatttacggatttgtagcagtgattg

SEQ ID NO: 3525 - DNA, 1130 bp, Oryza sativa
tcttcttcactgaggcaagttcttggccggagacaagaatgccaccagtgaatagcgacggagcaggaccaagctccggcgaggatggctctgcagccgccgtgaagaagcgcaacaggcctaagtaccatcggtttacgcagcaagaacttcaagcatgcaagcctatactgataccccagactgttattcttgtactagtgtttgtgggcctaattttcattccaattggtcttgcttgcattgcagcctcaaataaggtcgttgaattggttgatcgttacgatacaaaatgcgtgccacggaacatgcttcgcaacaaagttgcttttatccaaaactcatcaatagataagacttgcacaagagtcttcaaggtccctaaagatatgaagaagccgatttacatatattatcaacttgacaagttctaccagaaccacagaaggtatgtgaagagcctcaacgatatgcagctgagaaatccgaagaaggtggccgacacgcaatactgcagccctgaagctactgcgaatggcagacctattgttccttgtggtctcatagcttggagcctgttcaacgacacatacagcttcactcgtggtcatggcaacgagacattgagagtgaacaaggatggcatttcgtggaagagtgaaaggaatcgcagatttggcaagaacgtgtatcctaaaaactttcagaatgggactttgattggtggagggcagttaaatccaagcaaacctctgagtgagcaggaagatctgatcgtctggatgagaatagcagcactgccaacattcagaaagctgtacgggagaatcgacatggatctgcaggccggtgaccgtgtagaggtgacgatgcagaacaactacaactcgtacagcttcaacggcaagaagtcgctggtgctgtccaccgccgggtggctcggagggaagaacgccttcctcggccgcgcctacgccatcgtcggcttggcctgcttcctgctggcactgctgctcgcattgctctacttcgtcttccccatgagagaggagcatctgtcgctgcactacactcctgctcgacttgtacgatgattgagcagttgggcatggaatgttatggatctttga

SEQ ID NO: 3526 - DNA, 2403 bp, Oryza sativa
ttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggcatcgcctcattgttggcacaaaaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgcaattccagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcagcaagagaggaggggatccttcatggtgtggaaggcgtagtaggagagatcctgatcacgtacagttttttttttttcctgttttttgttctgtgtaatgtagactgggctgccctctctcctcccgtggcagctggcttcagatccagtggctatcttatagggtatgtttaccaaagtatcttcgtgccagcttggactccctaatcctcttaatctcttggcatctatagaaggaatgcaactctagaga

SEQ ID NO: 3527 - DNA, 780 bp, Oryza sativa
acccaggaacacatcatcatcatcatcatgtctccgatgccgtcgctgctactcgtgttcctggtcgcctcgtcggcggctggtgttgcggccggcggcggcggcggggagctgaagcacatccacctgtacatgcacgagacgttctcggggccgaacgccaccgagggcggcgtcgtggcgtcgccgttcaacacgacgttcgggcaggtggccgtgttcgacaacgagctccgcaccggcgaggacagggcagcgtcgccgctggtggggaggtaccagggattcatcgtcggcacggggcggagctcgccggggtacctgacgtcggccaccgtcgcgttcaccgccggcgagctcaacgggagcacgctgtcgctggagggccccttcttcggcttcgccggcacggcggagcgcagcatcgtgggcggcaccggcaagctgaggctggcgcgagggtactacctcctcaagctcatcggcaagacctcgccggagacggccgtctccgagatcgacttcttcgtcctcatgtacagctccacccactagctatgtataagcaagaagcgtgtaaacactagtgtaacactgtaccagcgaggcaccgttcttttctgatacagattctatcctgatttatgttagcacgttttttaaatagttaaatagtgtatagagaagttgctctaaaatatcaatcatttttttaagtttatagtaattactaaaatcagttattcaagttctaatgtgttttctcatttgacgtgtcct

SEQ ID NO: 3528 - DNA, 1372 bp, Oryza sativa
aatcttgacaccatctcgctcgttgggttgtctccgtcgaagcgagcggctcgatccccaccaccaccaccagcagcggcagcctcggccggcgcggcgcggcgaggtggggaagcgaggaagagtgggagggctctcgccatggcgtcgaagcagatggaggagatccagcggaagctggcggtgctggcctacccgcgggccaacgcccccgcccagtccctcctcttcgccggcgtcgagcgctaccgcctcctcgagtggctcttcttccggctcctaggcgacagatcgccgttcacgcagcagaactggcagggggatagcctcgaccgcgacgaggagaacagcaggatccaacacctggccgagattgcgaatttccttggtataacgccttcggttgacacggaggcaattcagggtagaggtagctacgatgagcgtgtagagcttctctgtctcattgttgatctagttgaagctagctgctatgctgacaatccagagtggagtgttgatgagcagctggcaaaagatgtgctgctcgtagattcaattgcagagaaacaagcccaaatattttctgaagagtgcaaactatttcctgcagatgttcagatacaatcaatttaccccttgcctgatataacagaactggagttgaagctctccgagtatactaaaaagatgtcaaatttgcaactgatggttcaggagttagcatctaagtatgactataatccgaatgaagactatgccgagacagagttaaaactgagggaacatttgcaatcgttcctagaaacagtaaaatccttcaatatgatctacactaaggaaattcatccttggacacatatgatggaggtccctcaattgcatggttttggtccagctgctaatcgcttgttggaggcatataacacacttttgaagttccttagtaatttgaggagcctacgggattcgtatgcagcaatggctgcaggatcgctttcagcatctaatgagccttcatctgtcaccaaaattatctccgactgtgaatctgcacttacattcttaaataacagcctttccatcctttcaacttctgtggcacgggagcagggtgagactctgaattcacagtagcctgatatcaggatacttgaataaccttgtagcaagtcgatcatttgctttttgtggcttgtagtattgccgttgtgccaattgtcgttgtgttcttgtgtctgtagttcgtaactgcatagatgaaaactttaacattagcttatattgaaatatcatgccgagagctctctttcaaggctgtgtacggctgcacgttgcagcggctgcaacgctgtacaaaataatgtgcgag

SEQ ID NO: 3529 - DNA, 902 bp, Zea mays
acgaaatgggtcagaggctgctcgaccgcttggcgggcttccttcttgtcgtcgtcgtcgtcgttgtcctctatggcggaacagagcagcggatagcagaggcggcggatggagcgaacccgcacaggctgctggccaccgtctcggtgtccaagccgtcgtaccccacggttgtcaccacgccgatgtcagcctacggcgccgacccggcctccaagccgtcctactccacgttcccgtcgctggcgaccgggaacggcggtgccggtgccggtgccggtgcaggcggtggtggtgcagctgcaggcagtggcgggggcggcgggacgtggtgcgtggccagccagagcgccagcccgaccgcgctgcaggtcgcgctggactacgcctgcggctacggcgcggactgctccgcgatccagcagggcgggagctgcttcaacccggacaccgtccacgaccacgcgtcctacgccttcaacagctactaccagaagaaccccgccccgaccagctgcgacttcggcggcacggccaccatcaccaacaccgatcccagttcagggtcgtgccagtacccatcatcaagcggcggcggcggcgctcagaacatggtgcccccgccatccccgacgacgaccatgccgccgacagtccccagtaccgtcccgatgaccccgacgccgacggcgccggacaccggtaccccggtctacgggctgtccccgcccgactacagcggctcaacttcccctcccggctacggatcgacgtctcccccggactacaacgacgtcagcgccgccgccgcgagggtgaggcagcagggcggcgcggcgctggcgctgacgcttctgtgcgtcgtcgtcgcgacagtgtcgctgcgcgtctccaaatgatga

SEQ ID NO: 3530 - DNA, 1634 bp, Zea mays
gcgacagagaatccatggcggcggcggcgtggtgggagacgctggtggtggcagcggcggcggatggaaccggtgggagcagcaccacggtggtgtccatctgcatgttcacgacggtgctgtgcctgtgcctcgtcgcgggccacctcctcgaggagaacaagtgggtcaatgagtccatcaccgccctcgtcatcgggtgcatcataggagtgatcgtatttctgctgaccaaggggaagcactcacacatcctgcggttcgatgagcagctcttcttcatctacgtgcttccaccgataatcttcaacgccgggtttcaggtcaagaaaaagcagttcttccacaacttcatgaccatcatgtccttcggcgtgttcggcgttttcatctcaggtgcaatagtttcggcaggctgctattggctcttcccgaaagtcgggtttggagaacttggtgcggtagattatttagcactgggagccatattttcttcaacagacaccgtgtgcacgttgcaggtcataaaccaagatgagacaccaaggctgtacagcctggtgtttggagaaggagttgtcaacgatgcaacggcggtcgttcttttcaatgccatcaaggatctcgatatcagtcggctcaagggtggggttgtgctaaaagtgatatttgacttcctctatctctttgcaaccagcactgtcctcggaatctcaatcggtctagtaactgcatatgttctcaaagctctgtattttggtaggcattcgaccgatagagaggttgccttgatggctctcatggcctatctatcgtatatgctggcagagttgctagagctgagtggaattttgaccgtgttcttttgcggcattgtcatgtcccattatgcatggcacaacgtgacagagagctcaaggattacaacaaagcatatatttgcaacattatctttcattgccgagacattcatcttcctttacgtcggtatggatgctcttgacattgataagtggaggacatcaaaggaaagcttcaagacatccatcggtatctttggcatcctcatattgctcatactactgggacgagtggcatttgttttccctatatccattttgtcaaatatcatgagtggaagttctgaaagaaccccgatcacattcaagcaccaggttgttatttggtgggctgggctcatgagaggtgctgtttccattgcactagcatacaatcagttcacattttcaggtgtaacatcggatccagttcatgccaccatcatcactagcacaataatcgtcgtcttcttcaccactctggtgtttggcttcttgaccaggcccctgatcagtggcatgctcccgcaccagtcgagggcgctgtccagaggccatagcacaggcagcaactccccgaaggatgacttcaccctgccgttcctgtcgggcgatgaaggcgcgtcaggcagcggtatcgtcttggagcaagccaagaggagcttgtctatgatgctggagaggcccgtccacacggttcacatctactggaggaagttcgatgacaggttcatgaggccaatctttggtggaccgcggtcgcactgactgcaggtgcatataagaggagtttga

SEQ ID NO: 3531 - DNA, 1166 bp, Hordeum vulgare
cgcaaccggagagaaatccccccgcaacaccgcgcgcgccgaatccgtcgccggaaaccgtccatccatcgaccggaccggcgggccgatccatccagccgtccgacgggagcaggcggggatggtgagcgccttcttcctcttctgcgggtgcgtggagcaggccaacgtggcggtggtcgagaagtggggccgcttcctccgcctcgccgagccgggcctccacttcttcaacccctgcgccggcgagctcgtcgccggcaccctctccacccgcgtccagtcgctcgacgtcagggtcgagaccaagaccaaggacaacgtgtttgttcagctgatctgtacaattcaataccgggttgttaaggagaatgcagatgatgcattctacgagttgcagaatccccaacagcaaattcagtcctacgtctttgatgtggttcgagccatagttccaagaatggagctggacagtctttttgagcaaaagaatgaggtcgcaaaggctgtacttgaggagcttgaaaaggtgatgtcagattatggttacagcattgagcacattctcatggttgacatcatccctgacgctgctgtccgcagagcaatgaacgacataaatgcagcccaacggctccagctcgcgagtgtctacaaaggagaagcggagaagatccacctggtgaagaaagcggaaggggaggccgaggcgaagtacctgtcgggcgtcggcatcgccaagcagcgacaggccatcacggacggcctgcgggagaacatcctcaacttctcgcactcggtgtcgggcacgagcgccaaggaggtgatggacctgatcatggtgacccagtacttcgacaccatcaaggagctcggggacaactcgaagaccaccacggtgttcatcccccacggcccaggccacgtcaaggacatcggcgaccagatccgcaccggcatgatggaggcatcgagcagcggcctgtaggccgtggctgtccgcccgccgcgtgatcatggttcggctgggtgggttctcggtgtgaggctgggagagtcgatctgtttatatattagattataatatagtggactatttcgtttgtttgatattcgtgtgttaataatacgggtgcggggacttcgttgtgtatgaagattgtcga

SEQ ID NO: 3532 - DNA, 988 bp, Hordeum vulgare
cgacagtcaccactcaccaaccaccacccgagtccacgcccccaaacccaaacccaagcccagccggcgacgatgtgcacgctggagcaacgcggccgcgtgttcgtcctcaccctcacgggcgacggcgagcaccggctgggccacccgctcatcgcctccatccgctccgcgctggcctcggtcctcgcggcggcccaggcccagccccagggcccgggggcggccctggtcaccgtcgccgagggccgcttcttctccaacggactcgacatcgggtgggcgggcgcctcccgcgcgcggctcggggagatcgtcgacgcgctccgccccgtcgccgccgacctgctcgccctccccatgcccaccgtcgccgccgtcacgggccacgcctccgcgggcggcttcctcctcgcgctctgccacgactaccgcctcatgcgcgccgaccgcggcgtgctctacatgagcgaggtcgacatcggcctccccctcccgccctacttcgtgcacgtgctccgcgccaagatctcccaggcgcacgcgctgcgggacgtcgtgctcaggggcaagaagctccgcgcgcccgaggccaaggagatgggcgtcgtcgacgtcgtctgccccggcgcgcccgagacagccgccgacgccctcaagctcgctgagcagctcgccgccaggaagtgggacggcgccgtgtacgcgtccattaggatgtccatgttccccgatgcgtgcagggccgttgggatcgccgtcgagagcgacgaggagaagagcaagcacttcgcctccaggctctgatcaggggaggtcggagagtgtctacggagcctgatgtctctcttggtattctgtatctgtacatggatcagccaatgatgctttgtatgaaacatgcattatatatattacttctgtaggcgttgtattttttgttactttgaaagtgtgaaacaaatagaatgcttgtgtgttaccgttg

SEQ ID NO: 3533 - DNA, 856 bp, Hordeum vulgare
acccagaacccgaagaatggcgcagtgtctccggggcaagggcggcgccgccgccgtcggggaggcgctccgcaaggtggccccgtggcggcgggcggcctcggcgtcgtaccaccacacgatccaggcggtgccgcgtgagacggccggcccgcgcgcggcggcgcgcgagcgccgcaacggcaacgtcccggccgtgctgctcaccctcgccggccccgggcccggggaaggggtcgcccaccggaagctcctcaccaccgacaagaagcagctcgcggagatgctgaagcagtcgccctacttcctctccaccccggtccgcctccaggtccgcgccggcgagcgatccaccgccgtcgtgcactctggcaccgtgctccccatcaaggtgcagacagatgaatcaacagggaatatattgaacttggtgatggtggaagcagatgaaggaacaatgctgaaggtgaatttgcccgtagtgttcaagggggaggatgtctgccctgggttaaagaaaggtgggttcttgcagaaaatcaggaccagtttggtgtatctctgcccggctgagcacatccctccaaaaatcgaggtggacctcacaaatgttgacattggggatagagtgttaatgcaggacatccccgtccatccatcgctcaagttactgagtaaaaacgagacgatgcccgtctgtaaggtcctgtcctccaagccagccgagtaggaacgccgtgccgtgcgaccgtctagagctggacacacctacctacaataggtggtacatcggcctgaaaatttaatccctctatctgctttgccttttggtacctagttgctatgctccagtttg

SEQ ID NO: 3534 - DNA, 1210 bp, Oryza sativa
cacacaccacagtcgcaatcagacattctctcttgttggttaactaaatagcttaattaatttgaggagtttagtctctgaaacatggcgatggcgacagcagcatgcagaaggcctgcagtgatgctcatggcgttcgccatggcggctgcggtgacgatgagctccgtgccgccggcgtcggggacgacgacgctgcagtacgacttctactcgtcgtcgtgcccgaaagccgaggagacggtgaggaacgtcgtcgagccgatgatcttcaacgaccccaccatgggcgccgccttcatccgcctcttcttccacgactgcttcgtcaggggttgtgacgcgtccatcctgctggacccgacgagcagaaacacgcagccggagaagacggcgatcccgctgcgcggctacgacgccgtgaacaagatcaaggccgccgtcgaggccgtctgccccggcaaggtctcctgcgccgacatcctcgccttcgccgcgcgcgactccgccgtcgtcaacggcaacttcgccttcgccatgccctccggccgccgcgacggcaccgcctcctccgcctccgacgtcgcccggttcatcccgtccccggcgttccacctccaggacctcgtcgacagcttcgccgccaagggcctcaccgccgacgacctcgtcatcctctccggcgcccactccttcggcctcacccactgcgccttcgtcaccggcaggctctaccccaccgtcgaccccaccatgaacgccacgttcgccgcggcgctcaagaagctgtgcccgccgccggcgagcggcggcggcgggagggcggtgagcaacaaccaggtgaccgaccccaacgtgctgagcaaccagtacttcaagaacgtggccgccggggaggtgatgttcacgtcggaccagacgctgacgagccgcgacgacaccaaggcgatggtcgacgacaacgccgccaacccggtggcgtggatggcgaggttcgcggcggcgatggtgaagatgggcggcgtcgaggtgctcaccgggaacgccggcgaggtcaggaaggtctgcttcgccaccaacacggcgagctgataattaagctacaagttctctttctccagcgatcggctggatcattaccacataatatatatattccttgttattttgatctcttaatttgtactccgtagttacctgcatcgattct

SEQ ID NO: 3535 - DNA, 305 bp, Arabidopsis thaliana
acaataaacaagataaatggagggtctaattccgttagtatacaaagccgtcatgcaaatccgttacggtaacgagtcgcagcaactttcttcttcttactacgttcgtcttcccggtgattcgggtcggtttgtaagatccgatttagatgtatcgggtcctggatctaattcctccaatagggcgtcgtcgtcgacaagcacaactacgtttgctgtttacgcgggagtccagtcacctgtttctcgtcaggttgtcacgtgattcacacgcgctttttgaaggaacctgaagttgcgtgtga

SEQ ID NO: 3536 - DNA, 399 bp, Arabidopsis thaliana
ggccgacacatctgatctaacaatggcgacgaacaacatcgtacgtttgatcgctccaagccgatccgtctcctctagattcctcgagccagtgtcacggtttctaagctccggtacacctcctccgccgcaagctccatctccgaatcaggatctgaaccgggacgtgaagccagatcagaatcttcaacagaatctgcagatgcagaaggaagaagaagaggaaggagaaggtggtggaggtggagagtttgtgaacgaagatactggtgagattggagggcctagaggtcctgaaccgactcggtacggcgattgggaacaacgtggtcgatgctctgatttctgagaggattcatgtatccctgtgttttagcttgttcttatatatttctggga

SEQ ID NO: 3537 - DNA, 719 bp, Hordeum vulgare
ctaaaccctaaccctagattggattagggggcgctgagagagggagagggggagtgtcggagcggcggcggcggcggcggcgagatgtcggcgaagaaggggctctcgagcacgctgcggaacctcaagtttatgcagcgggcggcggtcgcgcagaaggttgaggacaaggccgatgtggaggtggaggaggtggcggccgaggtggaggtggtgatgacgccggcggccaacggaggtggggttggctcgtcggtccaggtcgccaggaagtgtgtagttgtcatggagggcaatccacatccaggagctgtaaagggtcgaatgtcattccaaaatttcaatccatccattgataaactaaatgacgaggcaagtggtcgcccaacacaatcagcttcacctagtaattctcaacaagacagtgcaaatactagcagagtggatgatgtatcagcatcaagatttagaagcttcaatgttgatagttcagaaagcatatctctgaatgagttgaagagaaaagagcctgagctggagatggaaacaccaccgttgcgcaagctgccaaagacgactggccagaacgtggatggccgcgggtcttcacaaagcaatggtcgtgggtctggcaagtcgaacaagcatgaaaagcttgactttaatcttctaagaaaacggaaatcaaaatgaggtccaggttagcattagccaagtct

SEQ ID NO: 3538 - DNA, 498 bp, Hordeum vulgare
cgtctctcaagctcgcagcgcgcgcaccgagccgccggcgacgacgacgatggcggcgaccacggccgaggcggccctcctggtcctgctgctggtgaccctgggcggcgcggccaaggcgcagccgccgcgcggcacctgcggggcgcagctgagccagctggccccgtgcgcgcggtacagcgtgccgccgatgccggggcaggcgctcccggcgcccgggcccgagtgctgctcggcgctggggtccgtgtcccgcgactgcgcctgcggcgccatcgacatcatcaacagcctccccgccaagtgcggcctcccgcgcgtctcctgccagtgatcgccgcctggctccatgcaacgacaagaggaacaactgaagaaggcgaggatgaataagacgtcgatggtcggagcagacatcgagtagtagtggtagtagtactcagtggctgtccggttcgcctagatcgatctcctgtgatccattagaggctctcg

SEQ ID NO: 3539 - DNA, 477 bp, Hordeum vulgare
attgcactgcatagggctgtaaaacttggaaagtttctgaggcaagcagcagcagcagccatggagcctgctagtgctagtttagtctccttgagagcatccactgccacgaaccgtagctgcttcttgtgtcggcagccagtgacgcccaagaccaggatgcttccggccatggcgtccaagtccggggcgagactggtggcttcaggctgcaagacatgcagggggaagggtgcagtggaatgcgaaggctgcaaggggactggcaggaacaagaagaacggcaacatcttcgagagatggaagtgcttcgactgccaggggtttgggatgaggaagtgccccacctgtggcaagggaggcctcacgccggagcagagaggagaaaggtagaagaaacatcaagcatccatccatccatggcagcaccaggcagatgcactctccaatgtcgtatttatcatgctcaactcttag

SEQ ID NO: 3540 - DNA, 1015 bp, Hordeum vulgare
ccgaccacggattgattcccctccctggtcgcctatccgctgacggatcacgccggctggccgcccgcccgcccgccgccgcgagaccctgccggactgccggtgggcaggtttactacgatgagccctcctccgccgttgcgtccgactcccacttacagcctgcttctgctgctcttcttctcgctaaccgcatcggctgcacaaccaaaaggggtatgtgtttcacctggcggacggttccctgctttctcatctgaaggcaagcctcctggaaaagcggcaaaggggcgccgagacctagcattatgtaggatattccgccagaacacatgttgtgacgttacacagacatttcctgccctgctttcagtgagaaagctctcgtcaactggcgaaggcagtggagaatgccttcatttgtgggagttgctcgagtgctcagtttgtgatccaagggtgggtgtcaggcctggacctcctgttatatgtgcatcattctgtgacatggttttcaaagcttgttcggaggcatacttctccattgatatgaaaacacaggccttatctccttgtggtttaggtgacatcctttgtggcaaagcacataagtgggtttctaacggcacagagctatgtcgccttgctggtttctctgtgcaagtttctgatgccagtctcagtgaagttgacgaaaccttctgctatggcgggaaagcaagtttggattccatctctgatacatggacgtcttcaaaagatcgaccagcattacatggtatgccctcttgggatcttgaagattttcagagatgggcaaaagaaatgcctgttggtgaaagaatttcgtgggcagtcggaggaatggttcttacagcaggccttatttttatcagcaaaagagagggctacagccgtcgtcgtaagcaagcttccgtcgctcaaactgtaagaaaaaaatggaatcgggagctaacccgcagcaactgaagcgatgctaggaagacataggcac

SEQ ID NO: 3541 - DNA, 1110 bp, Hordeum vulgare
gagaaagtggaagagaacatgggcggcggcattttcccactgctggagccatggttcgtttccctggccgtcctcggcgcggtgtactcaacagccgtcgtgctccgcctcctctcacacctcaccctcctcctgcgtcggccgaggaacccccgccgccgctacggggcatgggccgtcgtgaccggtccaacgtctggcatcggccagtccatggccctggagctcgcgcgcttgggcctcaacctcgtcctcgtcggccgcgaccccgccaagctccaggatatctccgagaccatctccaaaacccacgccgtgcagactaagaccgtcctcttcgacctcgccctcatcgccactcctcaaggggacgaggcggtgcggcgtctccgggaggccgtggaggggctggacgtgggggtgctggtgaacaacgccggggtggccaagccatgcgcgctgtacctgcacgaggtggacgtggaggcgtgggtgaagatgatgcgggtgaacctatgggcgctgacggaggtgacggctgcggtgctgccggggatggtgcagcggggcaagggcgccgtcgtcaacatcgggtccgggtcgtcggaggccatcccttccttccccctctactccgtctacgccgcttccaaacggtacgttgctcagttctcccgaagcctctacgtcgagtacagaagcaaagggatcgatgtgcaatgccaggcaccgctgttcgtgcagacgaagatgacgtcgatagtcgcgggatccggcaagcggcgccgtggcgtgctgccgcggctgatggtgccgacctcggacgagtacgcgcgggcggcggcgcgctggatcgggcacggcccgatatgcatgcccaacctgggccaccgcctccagtggtgcctctgccgcgtcgtgccggaccggctgctcgacgcgctgcgcctgcgcgagaacctgcggcagagggccgtcttccagcggctcaggtcgccgaggtcgccgtcccatgccaacggcggcaagcagagctagcttggtccaggctgcgcttgtttgtgcatactttgtgtagtactgtgtgtgatttgacatggatctgtggac

SEQ ID NO: 3542 - DNA, 1352 bp, Hordeum vulgare
aggaaaccctaacgaagataccctgatcgattgtgcggcgcgccgtagatggagctcatcgaaagcgggttggcgctgatggacatctccatgggcgagtccagtacaaagacgaggatgaagagcattagagaggcggagttgaccaatctgaggcgcatcagagaatcgcaggagaggatccggaggaggcaggagcaacttcttcgcgatccacagccacctcttaggtacgagtttgaagaggaagaggagaaggctcctacagatgagcaggagactgaggagtaccgtaggatgtgggagatgtgctttcgcaacaatttcggttcaatcgacgcggaaacttctcttggtcccatttactgtactggaaccagcccagcagatgctcttccggagagttgcatgcagatcttctccatcaaagtcactgacctaaataatggtctcagcttgccactggaggttcacggctttgttgctgccagggactcggtagatcataaacgcaactatctcttcagatgcaccagggataactgccaaatcctcactccaaaggatccattcttgcacttaacaggcccctctcgggcagttctgttaattgcccgtgtcgcgattgaagttgagctaaaagtaaagggcaaaaaagagtctgaagatgaagtgttagctttcaaatggttttatttccacgaagggtatcatttagaagatgggatccgttttcgcatccccagcaagcgctgcatgcttgagtttgctttggcagtgctgcctatgtcagttgaggccattgtgggcatccgggttgttgatggctcatggcctgatcattgtcgggggttggttgtttgcagtaccaacagtgtaaaaaaagggaaagtggtgctgcttgattttcaaaatggagaactacctaccaagtcagatggtgtggttgagcttgcaaggagtgttgtttctattgattacccagagggagaactgactgtttctgtggaggcgtcgcgggatcgattttctgcacgaggtacagtcggctttgggatgaaagtgccaaggggaagtattactcgcacgtgtgatatggttttctgcaaaatgaaagtttcagtttcttggtcccttgtttcttgctatcgggtttaaagtccaaccttatctatttggccaaccttacccgtggtttgcccagctaagccattggactatttatgtatctatattgtcatgctttggtacctacctacctgttgtacttgattattcatgtttgcttcgatgtggtattactcaggctgctcaggtaatgagcatattagttggtgctactaaactttccc

SEQ ID NO: 3543 - DNA, 896 bp, Oryza sativa
gagctgctgattgtgagtcaagaacagttgtgaagagtgagaagaaagctagagaagatcaaatggcagctgaatcctccctggttccacaaacctcctctgaatcgattgcgcagaagatgggcttcttcagggtccctgaccttcttgtcaaactgagcagcaaatgtttgattgagctggatgcagtccgcagcccaacatcgcccctagacctcatattcttcccaggcctcggtgccaaatcgccgaggtcgtctttccttggcgacagggttgggcttggactggtggattcacttactgatgatagctccactcccttgggcagcaggaaggttcttcttggatctgagatgaggattactgataatgtaacttccaagaacagcttcactgctcctgtcgaagctggggtggttgatcagaaggatgagagtatgtgtgatgacctgaagggtagtttcatgtctctggatgacattgtcaattcagaggattacacccgtgttgtttgtcgtggtcctaaccctaggacaacccacttctttggagatcatgttttagaatttgaaggtgagcagctgatgcctgatgagagtaagagtgaggagagtttgccccctcgtctggaagagggtatgatgagcttctgttatttttgcggtgagaaactcgaagaagggaaagacatctacgtctatcagggtgacaaagccttttgcagcatggagtgccgggagaatttcatggaagatgagatggaagaaggcgaacccgatctctctgcacctcctagcagcccagtcgccaacgatggttgtattttccaactgatccagtgaacgagcatcagtaaacaacttgatatggtcttatctgaagtgctgtcctag

SEQ ID NO: 3544 - DNA, 747 bp, Zea mays
cgaccgagtcaatcaatccggcgagtggccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggaggctgttttggttgctgcgataagactgtaaagcaactgggtgaactgtccagaaacttgatcacccaggaccaaataaccattggagagccattttggagcacaaccaccatcgaggttgaaccagcagatctcagcggtgttacttcagtcaatacatctaacttggcctctggaactggtagcagtcataaccttcctggacttggtaataatggacttattctgtgggaacatacaaggcaggagtggactgaaactagaagtctacggctgaaggcgaagcaggttcgtgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatgggataacatctgggataacacatagttgttcctcaagagaggggaaaaagaatgacatagggggtgtaggcttgggatgaggtgatgagttggcctgtcatacttgtt

SEQ ID NO: 3545 - DNA, 1125 bp, Hordeum vulgare
tagctagcttactccacagtgcgcaaagcacaccacatcaacgatggcgactacgggcagccgtagtacactggttctggtctatctgaccgtcgcagtgctagtctcccctgccctgtccgcccctctggacggcgccggcttccactcggcgacgtgcccgcagctggagagcatcgtgttctcctccgtgcaggcggcgctccagcgggaggtggcgctcgccgccggcctgctccgcatcttcttccacgactgcttcccgcagggctgcgacgcgtccgtgtacctcaagggcagaggcacggagcaggccatggggcccaacaccacgctgcagccgcgggcgctgcagctcgtggaggacatccgcgccaaggtgcacgccgcgtgcggccccaccgtgtcctgcgccgacatctcggcgctcgccacccgcgacgccgtcgtgctctccggcgggcccaactacacggtaccgcagggccagttcgacagcctcgccccggcgtctcagaacgtcgtcaatggcctcccgtcgccggcgacctccagcgtatccgccctcgcgcgcgccttcagcggcaagggcctccgtgacctggccgacctggtggcgctctccggcgcgcacaccgtcgggaggactggctgcccgttcttccgcgaccgggctcagcgcatggacgacgccttctcccggaggctggcggccaactgcagcgcggccccgaaccggctccagaacctggacgtggtgacccccgacctgttcgacaacggctactacaaggcgctggtgaacagccagggcgtcttcacctccgacatggtgctcatcaaggaccgaaccacggcgcccatcgtgcagcagttcgcgcggaacaaggacgccttcttcgcgcagttcgccaagtccatggccaagctcgccaccgcgccgaggcccggcgggaacgtcggcgagatccgccgcaactgcttcagccccaacgccctgcgcgccatcgacaccgtcgtcgaggccggcgaggaggaaggattcacggcttctgcctgatttgcgtgcgtgcatttgctggcacgtgcatggcttcgtgtatgttagctgttaatttctgctcg

SEQ ID NO: 3546 - DNA, 561 bp, Hordeum vulgare
actcaacgtagttcctcacctgcggagttgcgtgggcgaaggcgagatcagaccaggagagaagatggcgcaggggacgctggaggtgctgctcgtcggagccaagggcctcgagaacaccgactacctctgcaacatggacccgtacgcggttctgagatgcacctcgcaggagcagaagagcaccgtcgcctcaggaaagggaagtgaccctgaatggaacgaaacctttgtgttcaccgtctctgagaacgcacgcgagctcgtcatcaagctcctcgacagtgatggtggcacggaagatgacagcgttggtgaagcaacgatcccattggatggagtgtatactgaaggaagcatcccaccaactgtttacaatgttgtcaaggacgaagagtaccgtggagaaatcaaaatcggtctgacgttcactccggaggaggctcgggatgaggatcaacccgaggaaaactatggtgggtggaaccagtcatcttgagaagaagcggatgttttgctgagctatggtgcgtgacaagtcgtgtgctagaactaaagctt

SEQ ID NO: 3547 - DNA, 930 bp, Zea mays
gaaccaaacctcggagaaaccctagcaaggccgcttgcccctctcaggcgcgacacagcatcggcgactagcgatgacaggatatcgcagccgcagtccgagccgaagctacagcccacggaggcggtacagccggagccctcttaggcgcaagcgctacgacgacccacgcgaccgctaccgctgggccggggccggcggaggcggggaccgacgtggttacggtcggccgttggcgcagtccggtctcctcatccgtaatatctccctcacagccaggccagaagatattcgtgctacatttgagcaattcggccctatcaaggatgtttacctgccaaggaatttccacacgagggaacttcgtggttttggatttgtcaaattccgctaccctgaggatgctgcaattgccaagcgtgagatgcatcatcaagtcattggtgggcgagaaatttcaatagtttatgctgaggagaatcgaaaaacgccacaagaaatgcgcatgagaacaagaactagtggtaggtacatggatggaagatacacaagactgtcaagatctccacggtctcgttcccactcgtattcaccgccgccttctccagttaggcgtgacttcaggggcagggggcgcccggatagttattcccctcagtactcactctctccacgccctcgggacagcaggcaccacaggtcagatggtcgctctccgactccaagcctagatgaccacaaacctaaggcgacaccagtcaatggtggacatggtccagcagttgcatccagatagtatgatgccattatggacgccttgaattgtgttcggaggctggagactgcagactatcttttcattaatcttctctaagagatgagtagggttgtagtaaacatatacttggtagttgtattacaggtgatggt

SEQ ID NO: 3548 - DNA, 1661 bp, Zea mays
gaatctggttgctcatctcatctcacgactcataaaaaaatagcgtcttttatcatatccgttgctcgcaaaacgcccccacacgccgccggcgaatcggcgactccccttgcgacgggaggaagcagccacgccgccgtctcggcgactccctgacgactgcctctccggtctcgaacgcgatctggcccatggtggctctggcgccgttggttcgtgagatctagggttgtcgagcgccgcggagtgggagcggatggggcgccggaagatgtccgcagcggcgccgccgtcccggagctggtccaacgttggcgggagcgtaatccccgaactacttgcaaaacacaaaatggacttggaaaatttgacgctgacaaaacatccaatcagaacattacattttttcctgttagccatgttacaatacttgaaaagattagcaacatatatcctgagaaagagtggtttgttctttctcttaattgttttggtggtagcttccggaatcttactctctatttcagatggcctgcataagaagcatgtgcaggagttccttaattatgctaaattcgtgttgtggtggatttcattaggtgtggcttcatcaattggactaggttctgggttgcatacatttgtgctgtatctaggtcctcatattgctctgttcactattaaagctgttcaatgtggccgaattgatttgaaaacggctccatatgataccatacagctaaaggttgggccatcatggctcgacaagaaatgttctgaatttggtccgcctgtgtatccagcatcagctcattctgttaggatccccgtctttgatttactacctcagatacagctggaagcagttctttggggcattgggactgcacttggcgagcttcccccttattttatatcacgagcagctcgcttatcaggaagcaagtcaaaagctgttaaggagcttgatgccgctacttccaaagaagatgggacagtagcatccactcttgatcgctccaagcgttggcttctttctcactctcaacatctcaacttcttctctatcttgatacttgcttcggttccgaacccactctttgatctcgctggaattatgtgtggccaatttggtgtacctttctgggagttcttttttgcaactttgattgggaaggccatcatcaagactcatattcagacgctgtttatcgtgtccttatgcaacaaccagctcctgtatcttatggaaaaggagctaatctggatattcggtcacattcctgggttttctgctaccctaccatctgtgattgccaaactccatgctgccaaggacaagtatctatcaccaccgacaccagtctcggcgtcctcacagatggaggagaaaagttggaatctctcttttacattggtttggaactctatagtgtggcttgtgcttctgaacttctccgttaagataatcacgtcgacggcacaggattatctcaaaaagcagcaggatatggagatggaacgcgtttctgattctccgcccccggaacaaaactaactagcggcgcaagtttatttcagctgctagctgcacagattctcctctgcatttttagcaactggttaagcgtctgcagacgattccaagttccaacgattat

SEQ ID NO: 3549 - DNA, 1368 bp, Zea mays
atcgagttgttcgtccgtcgcatgcaacttgcagcaggcgccttcttcttcggcgcgacgaactagctagctaggaccccatccggcggtgcaccatgctgcggtccaccggcgaccgcgtcgtcgtcgtgggcggcggcatcgccggcgccctcctcgccaagacgctccagaaccacgccgacgtcgtcctcatcgacccgaaggagtacttcgagatcccgtgggccaacctgcgcgccaaggtggacccggcggcggtggagcgcacggtgatcgcgcactccgactacctgacgcacgccaaggtggtcaccgcctccgccgtcggcctggacgactccgtggtgctcacctccatcggccgcgccgtggcgtacgacttcctcgtggtcgcgacggggcgcacgtgcaaccggccgcagaagcgatcggaccggctggagatgttccagcgcgacaaggagcggatcgacgcggcggagtcggtgctgatcgtcggcggcgggcccatcggcgtggagctggcggcggagatcgtgatgaagagccccgagaagcgcgtcaccatcgtccacggcgcgccgcggctgctcaaggtcatgggcgcccgggcgtcggccaaggcgctcgagtggctgcggtccaagaacgtcaccgtgctgctggaccagacggtggacctggcgtcggccaccccggacacccggacgttcaccacgtcggcgggggagatgctggaggccgactgccacttcgtgtgcacgggccggcccgtggcgtccggctggctcggcgggacgatcctcggggagcacgtggacgaggagggccacctccgggtggacgaccacctgcgcgtcggcgggctgcggaacgtgtttgccgtcggcgacatcacagacgtgccggaggccaagcagggcaacctggcgcagcggcaggcgatggtggtgtcccggaacctccgcctgctggtcaagggcgccccccgggaggagaagctgcaccggtacaagccgtccccgaggacgtccatgaccgtgacgctcggtcaacgcgacgcgctggcggagctgccgttcatgacgctcatcgggcacatcccaggtgccgtcaagccacgggacctcttcatcacgaggacgcgcaggatgatggggatcaagagcaaaccctacggcacgatgccgcacgtcatgtgagggagatcccatcgacgatgacgtccccggccccggtccggcgatccttcaattccgatgaccaaacggagactagctagataggctctctgtctctggattttgccacgttctagttctagctgatcatttgatctggtcgtctgagatgtacgcttggtgt

SEQ ID NO: 3550 - DNA, 774 bp, Oryza sativa
ggaagtccggagttggaagcgatcgatggcggctactacgacgggacgagttgttgcactcggcgcggtggccgtggtggtggcgctgacattcctcgccggcggcgcggacgccgactgctacgacttctgcttcaaggactgcatggccagggagaacaacatggtcgactactgcagctacgcctgcgacaagacgtgccagccggacaagcccacgctgtactcgtcgtcgtcgtcgtcccgcctcgccggcgacatggagtgccaactctcctgcgccttgggctcctgccaccgcctccttccggacggcaagggcgccgtggaggcctgcttcgggcagtgctacgacggctgcaagaccacggcggcggccagactgccgaggcctctccgcgccggccactacgtgctctctagtccccctgatgacgtagaccatgatccggaccaccgctacgtgttctctagcccccatgatgacgtagaccatgatccggaccaagtgttcgctagtccacctgacgacatagaccgccatgtattcgctgctcctcctgatgttctcgctgctcttcctggtgagccggaccacgcctgacaaaactgatcacacaacttcgctacctgctgcgaacgaataatctagcgctgcatgcagcagcagcatgcacacatgtgcacactaattatatgtcatatgcacttctatgtcgcaatatatgtatatgttctccatgtaaagatagcgtagtagcgtgtgagtgactg

SEQ ID NO: 3551 - DNA, 1196 bp, Oryza sativa
cggcgatggagggcgcggaggcggaggagcggaggctggcggcgtcgctgacggcgcggtactcggactgggtggtggaggcgctggacgagctcccggggagcttcatcctcaccgacccggccatgccgggccaccccatcgtctacgcctccagggggctcgcctcgctcacggggtacccgccgcgggaggtgctcggccgcaacgcgaggctcttccagggcgccgacaccgaccgcgccgcggtggccggggtgcgggaggccgtgcgcgggcagcggccgcaccaggtctccatcctcaactaccgccgcgacggggaagcccactgggtgctgctccacctcgcgcccgtcttccacgcctccgacggccgggtgctccacttcctcgccgtgcaggtgcccatcgcgccgcccgcgtcccggcgccgcacgccgccgtgccgggccgcccgcccgttcgtggtgttcgcggcgtgccgcgaggaggccagggtggaggaggagtgcccctgcgcgagccacgcgggggaggtgttcgtggatgtggataagagagggcaggatgctgaggaaccgcgggtagctagcgaacatgagaaagaaaaagcactgagtacagctaacagcatcttctctgcgttgaaccgctacagcaaactcactggtctagtggtctgcgggaagagatgtgattctgttggcatcccagcactcagttcttcattaaatctttctcttggtagaatcaaacaaagctttgtattgactgacccccatttgcctgacatgccgatcatctatgctagtgatgcttttctatcactaacaggttactcaagagaagaaatcttgggctgtaactgcagattcttgaatggtcctggcactagtgtggaggttttagaacagataaatcaacatatttgttctgagcaagcttgcacggttcatctactaaactacaggaaaggtggaagctcgttccgtgatcttctacatatatctcctatacgaaatgcatcgggcaaggtagcatttcacgtgtgggttcaccttgatgagggtgcaaagtatgattttaatgggctgacccccgaggtatggcagcttggtgctgttggtgcggtgagagtggcagtcagaagcttgtctgcgtcaggaagcctgttgagaccgtcccaatagtag

SEQ ID NO: 3552 - DNA, 1231 bp, Oryza sativa
ctgtgcttggagtagacacgagccggtgacgcgcatatcgtcttctgctcgagatcgatcgatcgatcgcttggttggttgctgcgactgcgagggaggccgcgggtggtgaggaggattgtgcaaaaaaatggggcgcgcgccgtgctgcgacaaggcgagcgtgaagcgggggccgtggtcgccggaggaggacgagcagctgcggagctacgtccagagccacggcatcggcggcaactggatcgcgctcccgcagaaagcagggctcaaccgctgcggcaagagctgcaggctccggtggctgaactacctgaggccggacatcaagcacggcggctacaccgagcaggaggaccacatcatctgctcgctctacaactcgattggaagcaggtggtccatcatcgcgtcgaagctccccggccggactgacaacgacgtcaagaactactggaacaccaagctcaagaagaaagccatgggcgccgtgcagccgcgcgccgccgcctcggcgccgagccaatgcacgtcgtcagcgatggcgccggcgctctcgccggcctcctcgtccgtcaccagctcgagcggcgacgcctgcttcgccgccgccgccaccaccaccaccaccatgtacccgccaccgacgacgccgccgcagcagcagttcatccgcttcgacgcaccacccgcggcggcggcggcggcatccccgaccgacctcgcgcccgtgccaccaccggccaccgtcacggcggacggcgacggcggctgggcgtccgacgccttgtccctcgacgacgtgttcctcggcgagctcacggccggcgagccgctgttcccttacgccgagctgttcagcggcttcgccggcgcggcgccggacagcaaggccaccttggagctctcggcgtgctacttcccgaacatggcggagatgtgggcggcctccgaccacgcctacgccaagccacagggtctctgcaacaccctgacataggaggacacgctaaaacctccattgaattcttgcgtagctgcgaacgcaacggcgatcgatcgatgcgtcgccacttgctactagcataattcttgctctcttttttttttcaatttttttctcttcttcgagtggcccattctctagctggcgttttctcgtgtattatgagtgatcgattattacatgtaaattaatccatagatgtatctgcactgatccaaattctcc

SEQ ID NO: 3553 - DNA, 1154 bp, Oryza sativa
gggacatgagggagacgggcgcgacggatgaggggcacgcgtgcgaagttgtagtagccggaggtgacggcaaggccgcggcggcacgccggcgccgacgtctcgagctccggcggctcgggctggcggcggaggatgatgcggcggcgaagagaatccggtcggtgaaggacgggtcgtcgtctgatgactcgtcgacggaggttgttccccggagctggccggcgtgcgtgtcgcacggctcggtgtcggtgatcgggcggcggagggagatggaggacgcggtggccatcgagcggacgttcatggcttcgacgggggatggtgcgggcgctatcaggggcggcggggagggcgaggaggacttcttcgcggtgtacgacggccacggcgggtcgcgggtggcggaggcgtgcaggaagcggatgcacgttgtgctcgcggaggaggtgagcctgcggcggctgcgggggcagagcgcgtcgggcggcgacgtgcgctggaaggaggcgatgttggccagcttcgcgaggatggacggcgaggtcgtcgggagcgtcgccgccgccgccccccgcgtcgacggcaccgagccgtcggggttcaggacggtgggctccaccgccgtggtcgccgtcgtgggacgccgccgcatcgtcgttgccaactgcggcgactcgcgcgccgtgctctcccgcggtggcgtcgcgctgccactctccactgaccacaagccagatcggcctgacgagttggaacgagtggaagcagctggaggcagagtcatcaactggaacggttaccgtgtccttggtgttttagccacttctagatccataggcgactactacctgaagccgttcgtgagcgcagagccggaggtgagggtggtggagaggacggacaaggacgagttcctgatcctggcgagcgacgggctgtgggacgtggtgtccaacgaggtggcgtgcaagatcgccaggaactgcctcaacggccgcgcggcctccatgttcccggagtccgtctccggcagctcggccgccgacgccgcggcgctcctcgccgagctcgccgtctcgcgcggcagcagggacaacatcagcgtcgtcgtcgtcgagctcaggcggctcaagagcagggcagcttgatga

SEQ ID NO: 3554 - DNA, 1777 bp, Oryza sativa
cttcttgctgtcgaacaccagatcgcaggagacaagaatcagtgagcatgcatcatgtcgtccaacatgttcggcaagaaagggtgggactcgaatgggatggatacatctggttctgtctgcagaagttcttcagatatcaattacattaatcaacgggcaagattgaagagtgcgagcctaaactgtgtgggttcgccgccaaggaagaacaacaatgctacacagtaccggatgtttgttgccacatggaatgtgggaggaagaactcctaataaacgacttaaccttcaagactttctgcaggttgaagaatctcctgacatctacgtcttagggtttcaggagattgtccccctgaccgccggcaatgtgctcgtcctcgaagacaacgagccggcggcgaggtggctggcgctgatccaccaggcgctgaacatgccccaagaaccggccgacggcgacgagccatcgcctttgacgccgccgccgtcgtcgtcgacgacgacgtcggagtcgtcgaacggcgcccggacccggcggcgcgacgccgtgtcgaggtcagccagcggcaacctcttcttccacacgccgtcgctcaagatgctcagcaacagctaccgcgtcgacagcgcgctagtcaagacgtgcaactgctcgccggagcactcctccgtgcgccgccgtgccgcggaggtgcgcgagtccgtgtacctcgccgacgcacccgcgccagccggcgagacggcggcgccagctgccgacgaagacgacgcgccgacgacggaggcgcagtgcgaggcaggatgcggcggcggcggcggcatgagctactgcctgatcgcgagcaagcagatggtggggctcttcctgtcggtgtgggtgaggaaggagctcgtcgagcacgtcggccatctccgggtggactgcgtcgggcgcggcatcatggggtggctcggcaacaagggctgcatcgccatcagcatgacgctgcaccacaccagcctctgcttcgtctgcagccacctcgcctccggcgagaaggaaggcgacgagctgcggcgcaacgccgacgtcgccgagatcctcaagagcgcgcacttcccgcgcgcctgccgcccggcgcccgccgccgcccgccgcgtccccgagaggattcttgaccacgaccgaatgatctggctcggcgatctgaactaccgcatgtcgttaagctacgacgagacaagaacactactggaggacaacgactgggacgctctactggagaaagatcagctgttgatcgagagagaagcggggagagtgttcagaggctggaacgaaggaaagatctgcttcgcgccgacgtacaagtacacgcacaactccgacgcgtacgccggcgagacggccaagtccaagaagaagcggaggacgcccgcatggtgcgaccggatactgtggcagggagacggcatcgagcagcttcagtacctgcgcggagagtcgaggttctccgaccaccggccggtctgcggcgtgttcgccgtcgaggtggacggcggcgatggcgacggcggcggcgccgccggcaagatcatgaagggttactactccctcaacgcccggatcggcggtgacagatcgcagtgtcaccagggtgacgtgtcgtgaactgattatatatttcatccccttttgcaagtttgcaatgatagggtcttgtgtataagaaggtttattaccaagaacagaggatattgtagatactagtatctgacaagaatcccatgac

SEQ ID NO: 3555 - DNA, 937 bp, Oryza sativa
ttcacacctcaccgagcgagcagctagctagctgcggcgatggcctccagagcggcggcggtcgccgtcctcctcctcgccgtggcggcggcgccgctcttcgccgcggcgagcgcgcatggccgaggctaccttggtgccaagtcctggcctcctgacggcagcctgagctcatcaagctccggcgaggctgcagcggcggacgtcgacgacggccacacggactggaagtgctactcctcctgcatgagcaagtgctgtcaccgccacgacgacgacgacgacgacaaggccaatgccaaggccaacgccaccgccggcgccgccgccgtcgggctcgacgatgactacaagtgcaagaagcagtgcctcggcaactgcttcaaggacgtgccggccgtttgctaccacaagtgcgtcgacgactggtgcgcgaagctgccaccatatagctccgcgaaggtgcagtgctacaagaagtgcggcgataaatgcttccaccacggcccgaagcctgggcccaagcccaagcccaagccgagcccaccaaaacccaagcctggaccgaagcctaagcctcccaagcctgggccgaagccgaagcctcccaagccagggccgaagccgaagccgaagcctccaaagccagggccgaagccgaagccgaagccgccgaagcccgggccgaagccgaagccagggccgccacagccctggtggcctataccattcccgaagccgccgtgtccccccggcgccgacgggtcgtcgtcggcggtcgacgacaagaacaactgatcacacgtcatacctaaattatacatatgattaatttgagatcaaagaatttacagagtaaatacagccagggcgacgtctcattgctgcaaattaactattgtatagatggcatatgcacggtaattgtcaagtgatc

SEQ ID NO: 3556 - DNA, 1434 bp, Oryza sativa
attcagtcttgtcggctacatctcttggcgtgctgaaattggtgggagcacgagagcggcgccaatggggacgaggccgtgcgccggcgtggcgtcggcggtggcggcggcggtggccgttctgctgctcgccgtgtcttgcttcgccgcggcggcgacgacgacgcagaagcatggcaggatgtcagggaagggcggcgacgtgctggaggacgacccgacggggaagctgaaggtgttcgtgtacgagatgccacgcaagtacaacctgaacctgctggccaaggacagccggtgcctgcagcacatgttcgcggcggagatcttcatgcaccagttcctcctctccagccccgtgcgcaccctcgacccggaggaggccgactggttctacacacccgcctacaccacctgcgacctcaccccgcagggcttcccgctccccttccgcgccccgcgcatcatgcgcagcgccgtccgctacgtcgccgccacgtggccctactggaaccgcaccgacggcgccgaccacttcttcctcgcgccgcacgacttcggcgcctgcttccactaccaggaggagcgcgccatcgagcgcggcatcctcccggtgctccggcgcgccacgctggtgcagacgttcggccagcgccaccacccctgcctccagccggggtcgatcaccgtgccgccgtacgccgatccccgcaagatggaggcgcaccgcatcagccccgcgacgccgcgctcgatcttcgtgtattttcgggggcttttctacgacatggggaatgatcccgagggcgggtactacgcccgcggcgcgagggcgtcggtgtgggagaacttcaaggacaacccgctgttcgacatctcgacggagcacccggcgacgtactacgaggacatgcagcgggccatcttctgcctgtgcccgctggggtgggcgccgtggagcccccggctggtggaggcggtggtgttcgggtgcatcccggtgatcatcgccgacgacatcgtgctccccttcgcggacgccatcccgtggggggagatcagcgtgttcgtggcggaggaggacgtgccgaggctggacaccatcctggcgtccgtcccgctcgacgaggtcatccggaagcagcggctgctggcgtccccggcgatgaagcaggccgtgctgttccaccagccggcgaggcccggcgacgcgttccaccagatactcaacgggctcgcgcgcaagctgccgcaccccaagggcgtcttcctcgagcccggcgagaagggcatcgactgggaccagggcctcgagaacgacctcaagccatggtagccgccatggatgatgagctatatacacacagattatagagacgagacatggattggatcgcgagagatgtacattgattggttcgtttcttctgattaagc

SEQ ID NO: 3557 - DNA, 1113 bp, Oryza sativa
agaaattaagttgccggagaggaggaggatgacgatgaggttggcggcagcggtggtggtgatggtggtggtggcggcggcggcgatgtcggtggaggcggagctgagcgtggattactacaagaagagttgtcccggagtggagaacgtggtgaggtaccatgtcgccaaggcgctcaaggcgaatcgcaaggaaggcgccgccctcgtccgcctcatcttccacgactgcttcgtcagggggtgcgacgcgtcggtgctgctggacccgacggcggagaacccgcacacggagaagacggcgccgatcaacatcggcctcgccgcgttcgagctcatcgacgagatcaaggcggcggtggaggagcggtgcccgggcgtggtctcctgcgccgacatcgtcatctacgccgcccgcgacgcctccatcctcctcagcaacggccacgtccacttcgacgtcctcgccggccgcctcgacggccgcgtctcccgcgccgccgacgcccagcgcgacctcccggactccaccttcaccatctccgagctcatccgcaacttccgccgcaagaacttcaccatcgaggagctcgtcatcctctccggcgcccacgccgtcggcgtcggccactgctcctccctccgcgcccgcctcaccgcgccacccgagcagatcctcccgggataccgcagcctcctcgccggcaagtgcgccgccggcgaggacccgatcgtgcccaacaacgtccgcgacgaggaccccgccgccgtcgccgccaccatcccgtccttcctcccgaagctgaggaagttcgagttcttggacaacagctactaccacaacaacctcgcgaggatcgtcaccttcaactccgattggcagctgctcacggagaagaaggcgcgcggccatgtccacgagtacgccgacaatggcacgctctgggacgaggatttctccgacgcgctcgtcaagctcagcaagctgccattgccgcccaaggccaagggcgagatccgccgccattgccgccgcgtcaacacccaccactactgattcttcatcctcatcatcccaacatcaagccttccatcttgagctctcatctgcat

SEQ ID NO: 3558 - DNA, 1709 bp, Oryza sativa
tccctaccctagtcgatctccccttcgcctcgtctccccgtctcctcctcgcgagctcgcccgcccgccggcgtcctgctgcatcccgccgagaaatttgggggttcagctgaaccctctatgcgcgacgatagatccgcccttggggagtagggaagggaggtgaggtgaggtgaggagataggaggagttgagaaggcgctgattgttgggaggaggaggaggaggaggaggatggtggaaggccccaagttcgccggcatgatgggcggcgtcgtcggcggcgccggcggccatgacgacattggtgggaatttctgcgacatggcgtactaccggaagctcggggagagctccaacatgtcgatcgatagcctcaatagcctgcagaccagcacgcatggcggtggctccgtggcaatgtcggtggataacagcagcgtcgggtctagtgattcccacaccaggatgctcaaccacccgggcctcagggggcatgtcgcagccaattactcggttgggcacagcattttccgccccgggcgggtgtcgcatgcgttgagtgaggatgcgcttgcacgggcactgatggacccgaggtacccgaccgagacgctcaaggattacgaggagtggacgatcgatttgggtaagctccacatggggatgccctttgcacagggtgcatttgggaagctatacaagggcacctacaatggggaggatgttgccatcaagcttttggagaggccagaggcggatccggagatagccgggctaatggaacaacagtttgtgcaagaagttatgatgcttgcaactttgaggcatcccaacatagttaaatttattggggcatgcaggaagccgatggtttggtgcattgtgacagagtatgcaaagggtggctcagttaggcagtttctgatgaagaggcagaacaggtcagttccattaaagcttgctgtgaagcaagccttggatgttgcaaggggcatggcctacgtccatgctcttgggttcattcacagggacctcaagtcagataatctcttgatttctggcgataaatcgattaagatagcagactttggagttgccaggattgaagtcaaaaccgaggggatgacacctgaaacaggaacctatcgttggatggccccagaaatgattcagcacaggccatatgaccagaaagtagatgtctatagctttggcattgttctatgggagctcattactggcatgctccctttcgctaacatgacagcagtacaagctgcatttgctgtggtgaacaagggtgtccgtccagccataccacaggactgcttgcctgttctcagtgagatcatgacaaggtgctgggatccaaaccctgatgttcgccctccattcaccgaagtagttaggatgctggagcatgctgaggtggtgatcctgagcacagtccgcaaggcccgatttcggtgctgcatctcccaaccgatgacaactgattgaatgagacaacagagagttgcgaagaccttgatggaaggaagcataatcgagtgtatttatcacatgttagactctgcgccgctgaagtagaaatccaacttgagtgtacgactgagttatatactcaggtgtaaggcagttctatattcaaaatatttctctcttagagtggtgttttcagactgctttggtgtgttaggctctat

SEQ ID NO: 3559 - DNA, 1343 bp, Oryza sativa
atattggaatgcttctgtcgtcgaatttggttatctacagcatctgaattggttataacttataacttataagtggcatgtctgcgaaggttccaaggcgcctagaagctaattccgttgggatggcagattgggctggtcttcagactgatatccttggtgtaattgtaaagaagcttgccgtccctgactatctgagattccgtgctgtatgcacatcttggaaccatctctgtagggatgtattcaactgtccaaggatagacccatggctgatgctccctacaaatgcgcttaatgattctaaatttttgtgtgtacctgaaaggaagaaccaaaccattcgtctcccgagcactgttacaatctttggctccacctggattcctgttggttcttcccatggttggctcatcttttacagcccatctcatggaaccatgcagctggttaatcccattagtggcatgcagttcaatcttcccccaatcggacgaagggccttctccaaggccatgttgcttgacatgaatgacacaaacttcactgttgctgtcatcttacgtgaccagaaaggatataaggtaacgcgtaaaggaagcaacagctggtcatcagtggaatcaaagcatgatctagtggatatcttcaagcacaggagacagctttacaccgttgatatatatggcacagttcagttgtgggcagaaccgccccgttcatggccagatgaagatgccccgcaggtgaatgacccgtatcataacctcattcactatccgcatcaacatggaaagcttaactgtttggtggagtccccagctggtgatctaatgagggtgaagcggcaatcaaatgataagtttgtggtctggattctggacaaggggacattttcctgggagaaggttgataacatcggggactttgcgctgtttgtcagctactacagctcggtctgttaccgggcgaaggatcatctcaacctgaagtcgaattgtgtctacttcattgactcctacagcaacctgtgcgcattcaacctggagaacaggacgaaggagctcgtcgaagctcttgagcccgcccatgcccacggtcatccagagcctcacgctgtccggcgcaggccggaaggacagaggtacatgtggttaatcccttcgctgagataaaccaatggaggatgaaagctacggtacacatccccgttgtctctgaacttactacagtatatgtgactgtcgctaatttcataaaagtattgggcatatctatagcacttctgtagataaatcaactgtctgaactttggacaactcgtggtttgtgattatcgtgta

SEQ ID NO: 3560 - DNA, 1377 bp, Oryza sativa
atggtgattcggttgttgttagttcagttaaatgttgcaagatatcatgaacaccaagaagattaagctgcacgactgccacttcggctcgccgctatgtgacccttcgccggcgccgcacctgctgagctccgccgccgccgccgggctgtcgttccacccggggctcgtgagctcggcggcgcagcaccagcagcacggcgcgggcggctggctgcacgaggagtactacgcgccgaggtcgtcgccgccgtcgtcgcttctcgcgcagacctgcgtcggctccaacgcgaccgcgttctacgccgccgagaacctgccgcagttcgacttcccagctctcggtacggcggcggcggcggcggccaaggcgccgttccggtcgtcggagagcgagctgtaccggccggtcgacccgctgctcctccgtgcggaccactcggtgaggacgtactacgtccggccgcagaagcgggattccggcgagaggacaccattgccgccgccgtcgcagcaacagcatcaggacagaatccacgggctcttcgccggcgctcccaccactcggcttctcagcggcgaacccaaaatccactcgtttccacctcaagtggcggcgaagccgattctgccggcgatggatgcgccgagcctgcagaaccagatggagaatcagctgacaaggaactgcatcggcgcggcaactccggtgacccccaccggaaacctcgccggatcaggtgcgccgagcaagacgcggatcaggtggacgcaggacctgcacgagcggttcgtcgactgcgtcaatcagctcggcggcgcagacaaggcaactccgaaggggattctgaagctgatgaattcggatggcctgacgatctaccacatcaagagccatctccagaaatatcgcatagcgaagtacatgccagcgtcatctgaagggaagcaactggagaaaagagcaacaggaaatgacatgcagaatctggaccccaaaactggaatgcaaatcacggaagcactgcgtgttcagctcgacgtgcagaggcgcctccatgaacagctagagattcagagaaatctgcagctgaggatagaggagcaggggaagaggctgcagaagatgttcgaggaccagctgaaggcgagcaggagcgtgatggaaccgcaggagctggacgacgtcgtcgccttcgccgccggcgacggagacgacgacgcgttcgatgacgtcgacgtgcagctgctggccgtcgctggcagcggctatgacgacgccgggttccagtccaaaataagctaggacagcctttttgcgttttgtgttttggcactttgatttgacaaatattgttctggttcttcgacgtatga

SEQ ID NO: 3561 - DNA, 3125 bp, Oryza sativa
ccggttctatgtgtaggaagaggaataatggcatgcattagtcatgtcttgagcaagagttggagtgctgctgccacagtagtcttctcctttttgttctctagcatttggccataagccatagttctttctcgagctgttgttgctgcaaaggcattgtcgcaaagtcatgaagaatttgatgtggcaattaatgcctatccggagaaagagttgaagcgattggttttccaggatttgttgcatttattcgctcataagaaacggcgagagagagagagagagagagagagagagagagagagagaggggaagcaagaagaggctctgaaagatttttgagtttgaatttcttgttcttgtgggcgtgtgcgtgtggagcggtggaggcatgaaaggcggcagctccgccaccgcggcgagcggcggcggcggcaacagcctggcgatcgtcgagcggcagaagccggcgacgtcgtgcgtggcgtcgctgttccagatgctcgccaagaagaagctcttctcctcgtcctccaagaagaccaagctgcttcccccagtgtgcacacagaagttctcgcctgggagaccacctgccggcggcgagaagacgccggcggccaagatgaggactctgctgcttgatgctccatactatccaaatgaagttaccactcgcttgccacctcctggccaagacaacaaaagcagtgaaatgtgcacaccgggtgtggtagccaggctaatggggctcagcgcaatgccagccaccagccatcaaaaggcagtaaaaaccatggatgcctccgagcttggtggtcaccggagtgaatgctcctatggaagcatatacaactcgcatcagaagcaacaaaagccagggcatatcagagatggccggcatgacaatggcaatcagctcgatgcagatgcgcagccggtgtggtcacggaagcatgcagcacacaagttagcctcacctattaagagtccaagatcagtttcaagcaggaacaaggttaggctgattgaagcagcagtcaaggtcctggaacccggtttacaatccaggcaccaccatcaggctcggagacaagcgcgcctcgagtatagatgcaacagcagtgatgtgcagagtgctgctgaagccatgcacgatttctccgatcaattcgcaagagaaatgtgtgatgttgatgcatcaaggtcaggtgctcaaaatgtaggagccacctctctgcacaattctacttccaatcagtggtccgaagaggatactatgaggaatgtttctgttaggaggccaaaccagaacatatcatgtcaagcacaatctgaaggaaaccataagggtcagaggaacggatttaaggacagtggtcagagaacatcagatgatgtccttgtttcaagtcaaggtgtccaaaaaatacagccgaaaaacatatcccgagagaatgttgattgtagacctcttaaacagaacaatctgaagcagaatgcattgcctgaaacttatagagcagcagatacagggcatatggtccaaaggcagaaacatagagctaaggagcaaaatgtggcaaacacagccaatgactttgtctgttcaaacagaggtatgaacaacagtgcatctttgaggtccaaaggaaaagtaaaggataaaatcggcatgccacatggtagtgcggagaacaggaacttgagcacaaaatgtcaccgaaccagtggcctgcatggtgattgttctaataaacagatatcaaagactgcaacactgaaagctacagagaaagacatgataattgcaaaaggtgcagggttagttagtgagaagccaaagtctaccagtccaaactctgtaaggaatgactcgcggagaaaggtagagtcacgcattgcttctaggggtaacaactcaggcatcatttccatctcttctaattcaccgagaaaggctgtcctcgctttgctgaatggtcatactaaaggatcagatagtgttgttctgggatctccaactggttcttgtcctaagagagactatcgtagggactgccaaaatatttcttcagaaagggaattggtcttgagtgaagctttacaaggcatatcaagtctggaaagtgcagaatcagtgtgctttaatcgaaatgagttgagaaacagagaaattctggacgacagagtaatgtcttcattgtttcgaaagacgagtgctatcaatgtaatggaagaatctccaagtgatgaatttctatggcagtgtaactttctggacagtctgacttttggcttcagagaggttcctagaagtggtaaattgcgtgaaactcataaaaagcatgaggttactacaaatgctagcgatccatcttattatgcagatgatgagtgcttttctgggagcctgctcaaaactgcagcatcagaagctggattcagagaccgacgccgctcggagaattgcacaatgcaacaagatggaactaacaaaagaaactccaggtgctctgaaactaattttggccaagacagcagcaacctgatacaccctggagaggttgcagcaactgttgagctgctactaacaaacgttcgccggtctacttctactactcctccacggacatcaaaggcaccattcaaggcgttccttgtcaagacattcgagtctgctctgaccaccgtgaccaccacaagctccacgaagaagaagaagaagaagaacgggttcagcttcaacgccggcgtcgtcaaggccacagaaggggagaagagcaggagcccgctgggaagcctcgcgttcgattccgtcatggagtgcttggactcgctgttcacccagttctgcgactccggatacaggtcgttctcgagggttcccctgatctgccccgaggagaggctggctgctcaggtggacagggagatcgcgaggtgcagcggcatggccgggaaggaggtggatgagctgatcgcgagcgacgtccagcactcgggggtggagatcggcgtggatgtcctgcacgaggcgtttgagattggtgcccagatcgaacgggatctgctccaagagctggtggccgagatcgggatggatatgttgaggcgtttgtgac

SEQ ID NO: 3562 - DNA, 544 bp, Hordeum vulgare
agttcaagaggctgtcctgagaagctcaaatggctcccaaagctgctgttgccaagaagggcgatgccaaggcccaggctgccaaggttgccaaggctgtgaagtctgggtcaatcaagaagaccgcaaagaagatccgcacgtctgtgacatttcaccgccccaagaccctgtccaaggccagggaccccaagtaccccaggatcagtaccccgggaaggaacaagcttgaccaataccagatcctcaagtaccctttgaccaccgagtctgcaatgaagaagatcgaggacaacaacacccttgtcttcatcgttgacctcaaggcagacaagaagaagatcaaggctgcggtaaaaaagatgtacgatatccaggccaagaaggttaacaccctgatcaggccggacggcaagaagaaggcctatgtgaagctgacaccagactatgatgctcttgacgtggccaacaagatcggcatcatataagtcagagagagcctcctgcagtaggcgcgtgtgtcgtggtttcttatgttattgga

SEQ ID NO: 3563 - DNA, 1325 bp, Hordeum vulgare
ctccagcacacggacgagccgccgtctcgcagccctcctcgtgtgcgcagcctctgcctccgtccatcgccccccttcgcggcatgggaatggagatgatcacgaatgtgtccgagtacgagaggctcgccaaggagaagctgcccaagatggtgtacgactactacgcctccggcgcagaggatcagtggacgctcaacgagaacagggaggccttctccaggatcctattccgaccgcgcgtactgatcgatgtgtcccatatcaacatggcaacaagcatcttgggctttgatgtctccatgccgatcatgatcgctcccacagccatgcagaaaatggctcaccctgaaggagagcttgctactgcaagagcagcagcatctgcagggaccataatgacattgtcttcatgggctacttctagtgtggaaagggttaactcagtaggacccgggatacgtttcttccagctttatgtttacaaggacaggaatatagttcggcaactcgtgaaaagggctgaaatggctgggttcaaggcgatcgccctcaccgtcgacactccgaggctcggccgcagggaagctgatatcaagaacaggttcatcttgcctccacatctggtgctggagaatttcgcggcgctggacctcggcaagatggacaagacagatgattctgggctggcttcctatgttgctagccaagtcgaccaatctctttgctgggaggacgtgaagtggctgcagaccattacctcgttgccgatcttggtgaaaggtgtcatgactgcagaagacactaggattgccatcgagtacggcgcggccggcatcatcgtgtccaaccatggcgctcggcagctggactacgtccctgcaaccatcagctgcctggaagaggtggtcagggaggcgaaggggcggctgccggtgttcctcgacggcggcgtccggcgcggcaccgacgtgttcaaggcgctggcgctcggagccgcgggagttttcatcgggaggccggtgctgtactcgctggcggtggacggtgaggcgggggtgcggaaggtgctgcagatgctgcgggacgagctggagctggccatggcgctcagcgggtgcgcgtcgctgcgggacatcacacgcgcccacgtcgtcaccgacggcgacaggatccgccgcgcacgcctctagatagggactaggaggcgccgcatactgctagtagtactatttgtgcgcgcgcgctggtcgatttgagatgccgctcgttcttgttcctccaatttgatcgatcgatttatctggcaataattcgtactcgta

SEQ ID NO: 3564 - DNA, 2311 bp, Oryza sativa
aaaggatccacaagcgtcttcttcgtcttcctcgcttgttctctgcctgcccctgcctagcttaatgtggaactaactaggagtattaattaattccttccactaattaccaagcggcaatcggcggccacggccagtgaggtcaccgtccgctccgacgacgacaagctgccactgctcactgctctctcgagtctggaagcaggcgttgctcggcttctctcactatgaagggccaccattccttgccgccgtcgacgccgcccaagcgccgctgcactgccctggccgccgccgtcccggcgctcgtcgtctgctccatcctcctgcccctcgtcttcctcctcggtctccaccgccccgggcatggatcggaggagcgcgccgcggttgtcatcagcactgaattagggtttagcaagcacaagcatctggatgggagaatgaagcacaagctactcaaggatgtttctagaaagaaaattcctggatctgatgggattttggatgagaaatctggtagtagatcaaagtccaagagtgtttctaccaaatcaaaagaaaagctcaagggtgttttctctttagttcagctaaaaaatgagaccagaaaaaacaaagaacttcatacacaaagaagataccagttaaaggacttatcctggagatcaaaggatactactattgataagaaagagaaccaagaccaagaagtcgagcatgagaaccccagatcctgtgaacttgaatatggtagctactgcctctggtctgttgagtataaggaagtgatgaaagattttattgtgaagaggcttaaggatcaacttttcatggcaagagctcactatcctagtattgcaaagctgaagaaccaggaaacatttacacgtgaactgaaacaaaacatccaagagcatgaacgcatgctcagtgacaccattgcagatgctgatcttccaccattttttgcaaagaagctagagaaaatggagcgcacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgacagtagaatatttcaaatcaacgtctattcatacggtccagtcaaacaagcagaaacttgaagaccccaccttccatcactatgtgatattctccaagaatgtgcttgcagtttcgactacaattaattcaacggttatgaactccaaggattctggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgttccgtaatcattatcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggaggtaaagtggtgggagctattcagttctgtgaagttaaattaggacaattgaaggcttacaccgaggaacgtaattttggcaccaattcatgtgtgtggttatctggtctgaatgttgttgaactgaaaaaatggagggatctccacattaccagtcggtatgatcaattgcttcaaaagttgcaaaaggacagtgtgacatcatttccacttaaagtacttcccataagcttacttgtctttcaagatttgatatatcctttggaagattcatgggtccaatcaggtcttggacatgattatggagttagtcaaaccgatataaaaaggtctgttactctacactacaatggtgtcatgaaaccttggcttgatttgggcatacatgattacaagggctactggaggaaatatatgaccaacggggaaaggtttatgacagaatgcaatatacattaataacagactaacagtgacatgagattcactacattctacatttctgggattttggagcaacagaactttcgggaacaaagagggttagagtgagatgaaatctgatgcagcattataatgaattgagtatagtaagggtggcatggggtaccttt

SEQ ID NO: 3565 - DNA, 710 bp, Hordeum vulgare
cacacagagcacagcacagagagcagagccatgagcaaggagaagcaccacagacacgagcaccacctccggcgctgctgcggcggcttcgccgcgtgcctcctggcgctggtcgtcgtcgtggcattcattgcgctcgtcgtctaccttgcgctccgccccaccaagccttccttctacttgcaggacctgcagctccgctccatcaacctcggggatccctccctctcagccaccgcgcaggtcacgcttgcctcccgcaaccccaatgaccgcgtcggcatcttctacaggcgcctcgacgtcttcgtcacctaccgcgatgagcccgtcaccgtgccggtctccctgccgcccatgtaccagggacaccgggacgtcaccatctggtcccccgtgctgtccggggagtccgtgcccgtcgccggatacgtcgccgaggccatgaagcaggacatcgccgccgggtacgtgtcgctgctggtcaagatcgacggccgcgtcaagtggaaggtcgggagctgggtctccggcagctaccacctcttcgtcagctgccccgccatgctcgccgccggccccggtggcatgccgctcgggggtggcctcaacggcaccgggggcgccgtcgcgtcactgaaattcacgcagccgacagggtgcaccgtcggcacgtgatagaatggaccgcgcatacggtcgcatgttca

SEQ ID NO: 3566 - DNA, 1314 bp, Oryza sativa
cactagcgcacagatctcctaccaccaccaccaccgccgcagccatggcgaccgggtactaccgcggcggcggcggcgccagggaccacgccgacgagcccgacgacttcgacgagtacgaccccacgccgtacggcggcggctacgacctcttcatcaccttcggccgcccgctcccgccctccgacgagacctgctacccttgctccgctccctccacctcctacgacgccccgcactactccgccgacgagccctccccctacgcccaccactccaagccgcagcccgcctacggcttccgcccccagcacgagcagcagcagcagccgtcctacgcctcctccggctaccgcccccagcacgagcagcagcaatcctacggctcctctggctacggatctaagccccagcccgcctatggcttccgcccccaggccgaggaggagaacacctacggctccggctatggatctgggtacggtggtggaggaaggaagcagcaggaagaggagagctacggctccggctacggtcgcaagccgcaggtcgaggagagctatggatcagggtatgggaccaagccgcagcaggaggagagctatggatcagggtatggatctgggtatgggaccaagccgcagcaggaggagagctacggctccggctatgggaggaagccgcagcaggaggagagctacggatcggagtatggttccggctatgggaggaagccgcaggccgagagctatggatcggggtatgggagcaggccacagcagggtggggaggagtatggtagcggtgggtatgggaggaaggctcaggaggagagctatggttccgcgggctatggcggcaggaagaccgaggaagagagctatggtggtggttctggttatggatatgggaagaaagcccaggaagagagtgaagggacctatggctctggtggttaccccaagccgaagccttacagtcaggaggagacgcagggttcttatgggtatgggtacggcgagaagcctgcgtatgagagtggtggatacaacaagccgagctatggcgggggagacgaataccagggaggctacggccgcaagaaacatgatgacaatgactctgatgatgaaaagaagcagcgttatcagaagcaccaccaccatcgccgccaggagtacgatgattaagcttccggtgcgttatcttctacggggccatcgattgctgctatcacttgccagccatagtactctgcgtgaataaaagatgctcctgctcagtcgtttcatcgttcgtctcatggacactatt

SEQ ID NO: 3567 - DNA, 3749 bp, Oryza sativa
acgacgaggaggaggatggcgaccccgttggccgacgagggctcgatcgccgccgcggtgatgccgcgctcgccttctccaccggccgccgccgcggggtcggcggccgaggcgccgatgctgatattcgtctacttccacaaggcgatccgcgcggagctggagaggctgcacgccgcggccgtgcgcctcgccacggagcggtccggcgacgtgggggagctcgagaggcggtgccgcttcctcttctccgtctacaggcaccactgcgacgccgaggacgcggttatctttccagcacttgatattcgagtgaaaaatgtagcaggcacgtattcccttgaacataagggggaaaatgatctgtttgcacacctgttctctctgttaaagcttgatgtgcggaatgatgatggtcttcggagggaactcgcgtcctgtacaggtgcaattcaaacgtttataacccaacatatgtccaaggaagaagagcaggtcttcccactgctcattaagaagttttcacatgaagagcaagctgatttagtctggcaattcttatgcagcatccctgtcaatatgatggcagagttccttccatggcttgctacttctgtttcatctgatgagcaccaagatattcttaactgcttacataaaatagttccggacgagaaacttctccaacaggttgtatttgcgtggattggaggggaagcagtgaaaacaatatcacacgatttttgtagtccttgttcaaaaagcaatgttagatgcaaggatgctattgatcaaacagacaagtatggatgctcacatgagcactttaaaactggaaagagaaagcgtgcagaatctagttatagtcagcttgttatgcatccaatagatgagattttgtgttggcacaatgctatccgaaaagaattgagcgatatagtagaagaaacaagaaggatccaacaatctggggacttctcggatatatcagactttaatgtgaaacttcaatttattgcggatgtgtgcatcttccacagtattgcagaggatcaggttatatttccagcagtcaacgatcaagtgtcctttgagcaggagcacgctgaagaagaacggcggtttaataaatttagatgtttaattgaacaaatccaaataacaggagccagatcaacagcagtggatttttactctgagctatgttcacaagctgatcagataatggagaaaatcgagaggcacttcaaaaatgaggaaacaaaggtacttcctcaagctaggattcatttttcatcagagaaacaaagggaacttttatataagagtctctgtgtcataccgttgaagttattggagcgtgttttaccgtggtttgtatcgaagctgaatgatcaggatgcagaagcttttcttcagaatatgtttttggcagcaccttcctctgaagctgcattggtcactcttctctctggttgggcatgcaaaggtcgctcaaagggcacctctaactctggaaaattcatatgcttgacaccaagggcactgagcagcccattggatgaaaatgggtttaaagactgccagttatgtccatgttctttacaatcagatatttgttctaggccagccaagaaatggaatgacacagaatctagtaacataagcaactgctcacaaacggctgatatagcattgacatgtaaaaacagtccttgtcacattcctgggttaagggtagaaattagcaatcttgctgtcaattcgtttgcttctgcagagtccttccgatcgctgtctctcaattattctgctccttcattgtattcaagtcttttttcatgggagacagatgcagccttttctggcccagataacatttcaaggccaattgacacaatattcaaatttcataaggcaattcgcaaagatttggagttcttagatgtggaatctagaaagctcatagatggggatgaatcttcccttcgccaattcatcggaaggtttcgtttactgtggggtctttatagagcacacagcaatgctgaagatgaaattgtatttcctgctcttgaatcgaaagagacactgcacaatgtcagccactcatatactcttgaccacaagcaggaagaagaattatttaaagatatatccactattctttttgagctttcacaattgcatgctgatttgaagcatcctcttggtggtgctgatgcagttggagcgaaccacattcatccatataataggatcgattggtccaaaaagaataatgaacttttgacaaagcttcaaggaatgtgcaagtctatccgggttactctgtctaatcatgtccatagagaagaacttgaattgtggccactatttgataaacatttttctgtagaggagcaggataagattgtaggccgtataattggaagtacaggagctgaggttctgcagtcaatgttaccctgggttacatcagcacttagtctagatgaacagaacaatatgctggacacatggaggcaagtaactaagaatacaatgtttgatgaatggctaaatgaatggtggaagagatcacctacttcttctggcccttcaagcgatgcctcccatccagaagaagatcatttccaggaaaagttcgatcagagtgaacagatgtttaagcctggttggaaggacatcttccgaatgaaccagagtgagcttgaggctgagatacgaaaggtttctcgtgattctactcttgacccaaggaggaaggcttatctaatccaaaatctcatgaccagccgctggatagctgctcagcagaaatcgccccaacctcagtcagaagatcgcaatggatgtacagtattacctggatgttgtccttcataccgagatccagagaatcagatttttggctgtgagcattacaaaaggaaatgcaaacttgttgctgcatgctgcaataaactgttcacatgcaggttttgtcatgataaagttagtgaccatacaatggaaaggaaagcaacggtggaaatgatgtgcatgcaatgcctgaaagttcaaccagttggtccaaattgccagaccccttcttgcaatgggctatccatggcaaagtattattgcagcgtatgcaagttttttgacgatgaaaggagtgtgtaccattgccccttttgcaatttgtgtcgtcttgggcaaggattgggtattgattttttccattgcatgaagtgcaactgttgcctgggcatgaaattgatagagcataaatgtcgagaaaagatgctagagatgaattgcccaatctgctgcgacttcctatttacatcgagtgcagcagttaaaggtctaccttgtggccatttcatgcattcagcttgctttcaggcgtacacctgtagtcactacacctgtccaatctgctctaaatccttgggagatatgacagtatactttggcatgcttgatggcttgctggccgcagaagagcttcctgaggaataccgggaccggtgccaggatatactttgtaacgattgtgaaagaaaaggaaggtctcggttccattggctgtatcacaaatgcggcttctgcggttcatataacactagagttatcaagattgatagagctgattgttcaacatcagattaaccaggcgagattttccctctcatattcgaaattccttttgaatatatatattgttgtaaatatacatcaacttaaagaaatccatgcgt

SEQ ID NO: 3568 - DNA, 891 bp, Oryza sativa
tagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgtcgacgccgacgccgcgatgaaggagcaggacaggatcgcgcaggaggagaagaagaggcaggccagggagaagggcgctggcttgccttaggctaaaactgcatag

SEQ ID NO: 3569 - DNA, 1132 bp, Hordeum vulgare
cttacccttccctgagatcccagcccgagcctacgcgccaggaattccaccggaatcctcccctcctagccgcagcgtcgccggattgattcaggaggcattcttggtggccggagaagtggtatttgctcctccgcttgagagaatataacagaggctgtagttcagatcatcatcatcaaacatgtcgcttctatcgaaattacggttggtcactgtggatgtgactggtactctgcttgcttataaaggacggcttggtgattactactgtatggccgctaagtctgctggaaagccatgccctgactatgatcgaatgcacgaaggcttcaagcttgcatacactgagatggcaaggaaatacccatgctttggatttgcagcaaagatgccaaccattgaatggtggagaatttgtgtcaaggattcatttgttaaggctggctatgactacgatgctgagacatttgagaaagtgttcaagagaatttattctgcctttggctcctctgccccgtactcagtgtttcctgatgcgcagcccttcatgagagagctgagggagaagggtatcacagttgggatcgtcagcaatgcagagtaccgttacaaagaggttatcttgcctgcattagggctgaatcagggctcggagtgggacttcggggtgttctcaggcatcgtcggtgtcgagaaacctgacccacaaatatacaagatcgcgctggagatggcggggaacgtcgcgccggaagaggcgctccacatcggcgacagctaccgcaaggactacgtccccgcacgaagcatcgggatgcacgcgctgctcctggaccgattcaagaccgccgacgccgagagctggaggaagtccggcgcgccggtgctccctgatctcgaagccacaaaggcatggctcgccaagaacccgaccgaggaacccgctgaggagccactaggggccgcgctgctgcgcaggatggccgagaagctctgaacctcagcccctggggtagttcctgttgtgctcttgctggggagtgagggagccaaggaaaagggatgtgttgtagtgatggttcactggccagtttcagtttgctggagctgcttgaactttggtagttag

SEQ ID NO: 3570 - DNA, 1107 bp, Hordeum vulgare
accagagttcataacaagaaggcattctctaccactccattccattccccacaagcagagggagagagagtgagagggggaagggaaagggggagctgaaggcatggagggcaagcacaccgatcaggcaaacgtgaaggcaaagcactccaaggtgatctgctgcaagctttacatctctgaaagccggaatgcggcgattgtggatgccatcagccgcataggccagaaaaaccctgaggtggttctgctcagcaagtttgatgacaagtactacaaccgtgtccgctacacgctcgtctcctacatcaccagcgaaagctcagccggtgaagctgtgttcggcccaatcaggaaggtactgctggagatgatcgaggctgcattttcagccataaatctccaagcgcacagcgggactcatccacgcattggtgtcgtggatgacatctcattccaccccttgagccccgcggccacaatggaggatgccgctcagctggctaagctggtggcctctgacattggaaatggcttgcaagttccagtgttcctctacgcggcagcacaccccaccagcaagagcgtcagtgcagcacggcgtgagctcggctactaccggccaaaccacaagggcgtccagtgggcaggccaggtgctcccccatactctaccggtaaagccggatgttgggccagctcatgtctctcgcgaaagaggcgccaccatggttggagctacacctttcgtggacaattacaatgtgccgatattctgcaaggatgtcccgaccgtgagaagaatcacccggagggtgactggacggagcggagggctcccaacggtacaggcgcttgctctcttccatggcgacaattgcacggagattgcgtgcttgctggatccagatcatgtcggtgccgatcaggttcagtggctggttgagcagattgcagaagagcaagggcttgaggttgacaagggctatttcaccgacctgtccaaggatatgatgctggaacggtacttcgagatgatttctgcagctgattgacatgaccacaattttcttattgtaatcatgcatgtctgcacttccatgtattg

SEQ ID NO: 3571 - DNA, 470 bp, Arabidopsis thaliana
gaagaagagatgggagttttctcattcgtgtgcaaaagcaaaggcggagaatggaccgcaaagcaacacgaaggagatcttgaagcttcagcttcttccacctacgatctccagcgcaagcttgttcagactgctctctccgccgattcatctggcggcgttcagtcttctttctctcttgtctctcctacctccgccgtcttcgtggtggtcattggtggtggtggtggtggaggatttgctgccggaggaggtgcagctgctggaggtggtggtggtggtgaggctgccgcagccacaaaggaggaagagaagaagaaggaagaatctgaagaggaagagggagactttggatttgatctctttggttaagagacctaaaacaactttgttagtgttctgaggtttttctatctcaattttctttttgttttctgatattttcgagactataatgtaatgtcagaaat

SEQ ID NO: 3572 - DNA, 353 bp, Oryza sativa
ttctcctcctacgttctactggacttgtgctgcgaggggagatctaccaatctgggcgtggattggtctgtttcttctggtgacaaaccttaagcttgctcggatttgttcggaacaataccatggaggtgagaccaatggttgctttgcgtgctgccctagttggtggggtagcagcatttgcgaagattggtgcggcgatgaaagctgcaggaggtgcgaaggttggtgcagcggctgcagcaatgacagctgcagcaacagctgctgtatctagcaaagacacaaacaaagataatccgaagactgaaacaaaatgatatgtgccttacttagtggagaaaccctgttag

SEQ ID NO: 3573 - DNA, 950 bp, Hordeum vulgare
caagatccgcagagatgatccgagcgatgctggtcgtcgtcagtggggagagccgccgggcagcggtggctggcgctggcttcgtcggccactgcggctactccacggcctcgagctcccagaggttggctggcaaggtggccgtgatcaccggcggggccagcggcatcggcaaggcgacggcggccgagttcgtcaggaacggcgccaaggtcgtcctcgccgacgtccaggacgacctgggccacgccgcggcggccgagcttggcccgaacgcggcatgctacgcgcgctgcgacgtgaccgacgaggcgcaggtcgccgcggcggtggacctcgccgtggcccgccacggcaagctggacatcatgctcaacaacgccggcatcgtgggctccctggcgcgtccccggctgagcgacctcgacctcgccgacttcgacgccgtcatggccatcaacgcccggggcgtgctggccggggtgaagcacgcggcccgcgtcatggcgccgcgccgcagcggcagcatcatctgcatggccagcgtcgccggcgtgctgggcagcgtgacgccgcacccgtacagcgtgtccaaggcgaccgtgctgggggtcgtgcgcgccgtggccggggagatggcgcgctccggggtgcgcgtcaacgccatctcgcccaactacatcccgacgccgctggtgatgcgcatcctggagcagtggtacccgaaggccagcgccgaggagcaccgccggatcgtggagggggacatcaacgagatggagggcgccgtgctggagcctgacgatatcgcgagggcggcgctctacctggcgtccgacgaggccaagtacgtcaacgggcacaacctcgtcgtcgacggcggtttcaccgtggggaaggcgcccaacatgccgccggcgccggcgctgtaaaacgacgcaagcacttaa

SEQ ID NO: 3574 - DNA, 365 bp, Hordeum vulgare
cgacgatggcggcggttcgatgcgcggctcggaggctcggtggcgccctgctccagcgaacgcaggcggaggaggcacgcctgctcgcgccaagcaggctcatgcgctcccgccacctctccaccaaggtctccggcgaggctcgcaacatccagaagaaaggggatgacatctgggcggggttcaaagagacggtaaagagggtgtcggagcgccccccagaaaagaagccaaatgtccttctgcagcgcatgatgttgatcgaacaagtgactaagagtgtggtctatggagctttcagggtgacagttgtgtatgcgactgctgctgctgctttcggtggcagttggctagaaaactagtag

SEQ ID NO: 3575 - DNA, 348 bp, Hordeum vulgare
ctctaccttcttcttcggtcagctctctcaagcaaaagcgaagggccatggagggcctcatcccgttcatctacagggccgtggcgcagtacaggaaggagggccaggtctccctcgccgacctcctcttcgacgacccctcctcctcgccgacggccacctcggcctacttccgtctccccggagactccggccggcaccagctcttctcggccgactccggtacggcggcgcggcggtctcccgcgcaccgtcggcgcaccatggagcacggatcgtggtgaccgaccgtggatgatgcgacgccgattgctgaggagctgcgagtattgttggcctagctaagct

SEQ ID NO: 3576 - DNA, 443 bp, Hordeum vulgare
aggccagaccaaaaccatggcggccaaccaccacctccgccggctcgcctccgcgtccgcccccgctctctcccgcctctccaagccggccccctcgccgctcctccgctccgcgttctccagctccgcctcccccgcggatcagccgccggccgctgcggcccagaagggcgaagcccagagcgccgtgaaggaggcagacgaggcgcagggcggtgctggttccggcgccacgaaggctgcggaggaggatgacggcggcctggacataaacgaggccacgggcgagatcggcggcccgcgcgggcccgagcccacccgctacggcgactgggagcgcggcggccgctgctccgatttctgagggtaagctttctcctggatccctgcttctttgtactcgtaaggatggcatggcggtggtcgtgtgtccatgttactct

SEQ ID NO: 3577 - DNA, 2512 bp, Hordeum vulgare
gagagaggagcaaagattcaccgattttctttctcctctccgcccctcgcccccctctctctccttccgctatccccaaggtcagctcgtgacagcaatcgttctgccggccgctgcctgccccccacgaggagcgcgccgccgtcagaatcatcctgaatcatcggcgcacgctgatacctctggtggttgctgctgagctggtgaaggagccctgcggagtcctgtgcacgcctctctcagccatcaataattgatcggacaaaggcaggtcagttagaatttttgttgggttgacttcacaagtgacatgcagttgcttcataataagtgagcagtcaaagttgtgacatgtctaattattactcaagcccgggcgacgaaagggacccgcaaaccatgtactcaccggagacgggaagcgcatcgtatcccgtgccatcagccctggggaacttgctctattcaaacaatgcatcttctgggccgtatacggaattcagtggcataatccagcctcagcagaatttcatggagctgcatggccatccttcagaacattcatcatcaagggaacctaacatggtcacttcgcttgcagagcaaagctccttcgctcctgtcaaagatatgagaaatgagatgttgatgcatttcatggatggcgcacacagtggtggtggtgatctcatccacaatgatgcccatagcagtgcgcagcttgagtttggcttgttgaacaaccccagctcggcgattgttccatcagcaccaggccaaggattgtcgctgagcctcaacacacatatcctggcaccttcatacccatactggtccccaaagccagacttattgacgacccaatcttaccagggagatgaaaacggaatgaagaatatgcagtcggaggcctcacgggcaatcaggaattcaaagtatctaaaggcagcacaagaattgcttgatgagattgtcagtgtttggaagagtataaaacagaatgcgcagaaagacaaggttgaagcaggaaaaatggatggaaaagacgctgatgaggtgttgaaaagcgagggggtatcttccaacccacaggagtctgctgccaatgcagaagctgagatttctgcggctgagaagcaagagctccagaataagatggcgaaacttttggccatgttggatgaggttgaccgaaaatacaagcattattttcatcaaatgcaaattgtagtgtcgtctttcgatatgattgctgggtctggagctgccaaaccttatactgcagttgcccttcagacaatatcgcggcatttccggtgtctgaaggatgccatcaacgaccaggttaatgtcatccggaagaaactgggagaggaggataattcatcgggcagagagggcaagttaactcgcctccgtttcattgatcagcagttaaggcagcaacgagctttccaacagtatggtatgttacagcaaaacgcttggaggccgcagaggggtctgcctgaaaactcagtttcaattcttcgtgcttggctgtttgaacacttccttcacccgtatccaaaagattcagaaaagctaatgctagcgaggcaaactggtttaacaagaagtcagatttcaaactggttcataaatgcccgtgtccgcctgtggaaaccgatgatcgaagacatgtataaagaagagaccggggaggccgagctcgactcaaactcctcctctgacaacgtaccaagaagcaaggacaaaatggcatcctgtgaagacagagaagatcagaaatgctccatgagccagggccaggcttaccaaaccagtgaattcaaagccaacgttggaatggtgggcctcaccggagggccggccagcttccacaatgaggcgagctccgacgacggcttcatgaacctgctgttgaaggaccaaagaccgggcgaggcggacggcggtctcctccatggtgacgagagcgcacggttcatggcctaccatctggcggagctggggggatatcagaacagcaatgtgtcgttgacgctaggactgcagcacactgagaacaacctttcagctccaaacaacactcaccggccaggtttcaccgtgggcggggaaggggatatctacaacactaccgcggctcatcccggtggtggcgccgccgccgcctctccggattacgaatcgacgaaccagttggatcagcggcagcagtttgagccgtcgcctctgctgcatgatttcgtggcctaagtgaaatgaacgctcgttgctggtgaagatgggatggggaggattatctgtaatttgtaggccatgataataacgtgcctgaaaaagcctggaaattgtagctgtagttgcatttggtatagaagagagggggtatagcatgaaatgtattataagtttgtgggggtggggtaaataatttttgtaaagatgaatggaatgcattatacgtgtaaaagattatgaatgaagaagaccaaccatcctgtac

SEQ ID NO: 3578 - DNA, 456 bp, Zea mays
gcatctaagccgaattgaagcatgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtatccggtccttcatggctaccacacttcggtagtcatttatcgtgacggttggagctacatgtaccattgtacgaacactgggaggtcgatcttgttggggaccaagggtgcaggtactgagcatgaaatag

SEQ ID NO: 3579 - DNA, 1235 bp, Oryza sativa
atccagatgcttcacattcttgacacagctcaactcgtctatataagcagctcacagctttagctttgcttctcacattatcactcagacactcacacatacacagtcttctcctagattaatctgagctcttcttgccgggatggcgaagaagcagagcttgttgcttgcaatgatgctcgtcgtcgcaggcttggctgtgtcggcgatggcggataggaagctgatgtctttggtcaagccccagccgaaccagctcacgtaccacaatggcgccgtgctgagcggcgacatccccgtgtcgatcctctggtacggccggttcacgccggcgcagaaggccgtcgtcaccgacttcgtcatctcgctcgccgcgccgctgcaggcggcgccggcgccgtcggtgtcgcagtggtggggtagtattcaccggctgtacctctccaaggcggtggccgtcggcaagaacgggggcgcgcacggcggtggcggcggcggccgggccaagaacgcgcgcgtggtgctgtccgggcaggtctccgacgaagggtgctcgctggggaagagcctgaagctgtcccagctgcccacgctggcggcgagggcgaggccggggaagggcggcgtcgcgctggtgctgacggcgcaggacgtggcggtggaggggttctgcatgagccggtgcggcacgcacgggccggtgtcgcgcgccggcgcggcgtacgcgtgggtgggcaactcggcgacgcagtgcccggggcagtgcgcgtggccgttccaccagccggtgtacggtccccaggcggcgccgctggtgccacccagcggcgacgtgggcatggacgggatggtgatcaacgtggccagcatggtggccggcgcggtgaccaacccgttcggcgacgggttctaccagggggagcgcggcgcggcgctggaggccgcgacggcgtgcacgggcgtgtacggcaagggcgcgtacccgggctacgccggcgcgctgctggtggacaaggccaccggcgccagctacaacgcgcacggcgcgcacggccggaaatacctcctcccggcgctcttcgaccccgacacgtccgcctgctccacgctcgtgtaacctgtccaccacgcgtcgggttgtgtattgtgtacatgctgatagtagtatgtctgtatgtatgtatgtgatgtgagtacgtgaccatgttgtgtacataagttcgtgtcaaactcga

SEQ ID NO: 3580 - DNA, 841 bp, Zea mays
ctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaggcgcccgccgccgcgcccgccgcgtcccaggggaagcccaagaagggcgggtcctcggacgctccctccgggtcggccggttccgacgacgccgcgcccacgggcgccgccggcgccagggtcgtcggctggagcttcgccggcctcgccgccgtccttggctgtctgttgtgagagtgagaccgtgcgtcgttt

SEQ ID NO: 3581 - DNA, 832 bp, Oryza sativa
attcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggagatggaggtgaagctgtggaacgacaagcgggagcgggagctcctggagagcctcgccgacctgtacgccatcatcaaggcgacggagaagctggagcgcgcctacgtccgcgacctcgtctccgccgccgactacgaggccgagtgcctcaagctcatctcccagttcaactccctctcctcctcgctcgccggcgtcgtcaccatcccccggttcgtcgaggcctaccgcctcgactgccccgccgccctcaaccgcctcgttcagtccggcgtccccgccaccgtcgagctccgcgccgcggcgtcctcgtccgcgccggcctcctccgcggcgtccgcggccgccatcgcccagtgcgtccagagctttattaccgccatggatgccgtcaagctcaacatgctcgccaacgaccaggtccgccccttgctccacgacctctcgacctccatggggaagctgggccccgtcctgccgccggacttcgaagggaaggtcaaggtgagcgagtggctcgccaagctaaataagatgggggccggggatgagctcaccgagcaacaggcaaggcagctcaacttcgatctggattcggcgtacagtgcgttcatggcatcactgcccagcaccggcctatgagcaagcctcatcctggttctgagttggtag

SEQ ID NO: 3582 - DNA, 1428 bp, Oryza sativa
ctcgtcttcgtctactccaccaccaccatctcctctccctctcgtcttccctggcgcgcgcgcagccggggcctccgtcctctcggcagcacgaattgaattggaggcacatttgtaaaaatgggagtttaccttagtacccccaaaaccgagaagctatctgaagatggcgaaaatgataagcttaaatttggactctcatctatgcaaggatggcgtgcaactatggaggatgctcattcagctttgctagatatcgataatgacacatcattctttggtgttttcgatggacatggaggaagagtggttgctaaattctgtgcaaaatatctgcacagagaagttctcagaagtgaggcctattcagcaggtgacctgggcaatgcagcccataaagctttctttagaatggatgagatgatgcgaggtcaaagaggctggcgagaactacaagcacttggagataagataaaccagattagtggcatgatagaaggcttgatctggtctccaagaggcagtgattcaaatgatcaacacgatgattgggcttttgaagaggggccacactctgactttgctgggccaacctgtgggagcacagcttgtgttgcaatagtaagaaatagccaacttgttgttgcaaatgctggtgattcccgctgtgttatctcaaggaatggtcaggcatacaatttatcaagagaccacaaaccagagcttgaagcagagagagaaagaatactaaaagcaggagggtacatacagatgggacgagtaaatggaactataaacttgtcaagggcaattggtgacattgaatttaaacagaacaagttcttgtctcctgataagcaaatgttaactgcaaaccctgacatcaacacagtggagctttgtgatgatgatgactttcttgttttagcatgtgatggcatctgggactgcatgtctagccaacagctggttgatttcatccacgaacacataaacacagagagcagcctttctgcggtatgcgaaagagtgctagatagatgcctggctccatcaactttgggtggagaaggatgcgacaacatgacaatgatcctagtgcagttcaagaagccaattagtcagaacaagaatgtcagtcctgcggaacaatcagctgccgacaaacaaccaactggagacacacattggtctgagattcatgtgaccgaggagagtagctcgtgatgttctagcccgataaaaccggtacaccaaagaacacccagtgtatcctgatgcgatatcgcaattggctaaacaggcataattcacgaaatttcggtgtacataccagcctcgttaaattgttgacacagcgtttacacccgtggccattcatgttctgctgcattagcagccaatcagtttgttattctccaaagctcc

SEQ ID NO: 3583 - DNA, 2113 bp, Oryza sativa
tcatcagttccctgttcttcagctattcagtgattcagttgtcatttgctctcaccccgttgtcatattgtcaagctgtgatggataacagctttgtggatatcccaaatcaacctccaatgaataacccgtttgtgttaatggaaccctcagctcagagctacatggtgaaccttggcaaaagcacaccccacatggactgcctgggatctgcaatggctaattatggccatggtaatcaaaatatacagtgcattgatagcatcacaactagagatgatggttgcaggttagtccttgggttgggtccaacgccgaatttttactctgcagagtgtcagcccactggagtagacaagcttaaagaagctccttcgttatctggacagggtttgactatcaccgatcctgggacattgaggcttggccttcaaatggatgtttctcaaacaattcaacctttgcaagcaccagatggaacagttcattcttttactgttgttgatgaagcctcagcatctccttctgtaaggagcatcggtggctacatgccatccctactctttgctccacgctccggttcttctgctgtcaatgagacccacgaagcagaaacccaggattcactagacctgacgcacagcgacaatgataacactcagcacgttcaacatcaccttcagctgagccctgagccttctgccatgacagatacttcatttggtgtgagctccgacgttgtcacggcaacaaccacatcagaacaaaggaatcatccccggcatcccaagaagtgcaggttcaagggatgctcgaaaggtgcgagaggcgcatcagggctgtgtattgcccatggaggtgggcagagatgccataagcctgggtgccataaaggtgcagagagcagcactgcctattgcaaggcccatggcggtggtcggcggtgcgaggagcttggttgcaccaagagtgctgaagggaagacagattattgtatcgctcacggtggaggtcgtcgttgtgaacatgatggctgtcctaaagctgcacggggtaagtctgggcggtgcatcaagcacggtggtggtaagagatgcacggtgcaaggttgcatccggagcgctgagggtaaggccgggctctgcatttctcatggtggtggccgccggtgccagttcccggactgcagtaagggggctcaaggcagcacattgtactgcaaagggcatggcggtggcaagcggtgtatctttgacggctgcagcaaaggtgctgaggggagcacgcctctgtgcaaagcacacggtggcgggaagcgatgcatgttcgaaggtggcggcgtctgcccaaagagcgtccatggtggcactgagtactgcgtggcgcacggaggagggaagcgctgttcggtggctggctgcaccaagagtgcccgtggccgcacggactgttgcgtgaagcacggtggtggcaagaggtgcaaggtcgacaactgcagcaagagcgcccaggggagcacggacttctgcaaagcccacggcggcggcaagcggtgcacttggggaacgggctgcgagaagttcgcccgcggcaggagcggcctgtgcgccgcgcatgggaccttggcggccaagcagcaagagcgcgacgcggcgaacaacggcgcgggcatgatcccgccaggccttttcagcggcatagtgaccgtcgctgccacgagcagcatgacgaacgagtactcgtcgtcgggcatcagcaccgcgtcggactgcgacggcacggtgaggagccaggcgatgatgatacctccccaggtgctggtgcctcgctctatgatgccctcatcgtcgtccgaacctaccgtgcatgggggcagagagggaggctgtgccgttccggagggaagggtgcacggtggcggcctcttgtcactcctcggtggcagcttcaggaacgccgacatggataagctctgaatttgcttctccggctgccgaattctgttagtttggttgtgtacataaacaaggcaatttattttgccgatttgaacttctttggctttttttcctttgtctagataaatggtccgtggttgctttagtccagtcat

SEQ ID NO: 3584 - DNA, 1042 bp, Sorghum bicolor
ctcttgctaggagtagcctgccccgtgtgcgcgctcgcacggacatgcttcttgccgcgtcttgaaaggggagaaaaagtggagatgggtacttgcgcttcggttcacaaggacccggagtaccccaagaagcagtttcttgactcgcccaccaaggcgaagacagccaacgggaagggcggcggcggcggcgttgctccggttggtgatggctttggtgatctcaagtccaaggtcgacgctgagcagcagcgggcagagtttaaccccaagagcccggattctggtagcaaggatgaagtgttcttcgagtctcgagcttggttagattctgactgcgaggatgacttttacagcgtgaatggagatttcacaccatctcgtggcagcacacccatctaccagcccagagcacagacggtgatgagcaacatctttcaaccagacacgcacagctccaaatcaccagagccttctccaactggacggaggaagctagctgagctcctgcaggaggcaatgcaagacggccctgaagaaagcaccgacgagcagcagcagttgcaatctgttgtcgcagatgggaagccggtgtctgaatccacatccagctccgcttgcagcactgtaccgacgccgacggcagtcgacaagagcaggaaggagaaggcatggtatactggacgctgttgcctgccgagctttgttcatagcctgaccttagatgagagtgagagggggcagaagatgagctctaggcaatgtgctgtttgacagtggggctcaagtgccctcctgccctgagctgtatttaccggattgggacgctgaagagtactatatatgcatatccttagtaatcaagtggataatatagcagtactcgttaaatgctgtgcacaccatgttaatcaattgtgagggcagcgaatggtccttacctgtgcatatatcttatcgaatctttatggatatataaatatatatacttttcagatgtcaacagccagctgagctaaggcatgtggcatgtaggataata

SEQ ID NO: 3585 - DNA, 1341 bp, Oryza sativa
cactccctcttatagcccaccgccaccggccgccgcgcgcccatggccgccgtgttcttccaccatgttgtcggcgacctcaccgtcgggaagcccgaggtcgtggagctgcacgacaccgacacgctcgacgccgccgcgcgggccatcgcggccagccccgagggcgccgtgcccgtgtggcggccccgggcggcgcccgacgagccgccgtcgggcgccaggttcctcgggatgatctccgcgctcgacatcgccacgttcgtggccgcttccggcgtcggtgaccgggccatggccgccgtggtcggggaggtcgtgcagcccaaccctggcctgctccgggaggtcgatccaggcacgaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacggacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacacttag

SEQ ID NO: 3586 - DNA, 1320 bp, Oryza sativa
tctcgtttctcctaccctacaggatgtttagataattcgagaccctagctttgaactttgagtaggttcagttcttagctgtagaagatgaatggttcaagtggctcccaaggacataatgtcaatggaggacagaagaaagtgcagcatgctagcccactcactctgaacaatgggtcaaagcaccgtccattgactcccatgagacgatgccgcggtgtagcatgtgtggtgatcatactgtcaacagcattcacattgatagttttcatagcccctattactactttccttgttcggctagtcagcgtgcattacagtagaaaggcgacctctgttctgtttggaatgtggctatctttatggccattcttgtttgagaagatcaacaagaccaatgtggttttctctggtgaaagtgtacttccaaaaaagcgtgtcttgttatttgccaaccacaggactgaggttgactggatgtatttgtgggatcttgcattgaggaaaggctatttaggatatatcaagtacatccttaagagcagcttgatgaaattgcctgtttttagctgggcatttcacatttttgagtttatcccagtagaacggaaatgggagattgatgaagcaattatccagaacaaactgtcagcatttaaggaccccagagaccccctctggttggccgttttccctgagggcactgattatactgagaagaaatgcatcaagagtcaagaatatgcttcggagcatggtctgcctatacttaaaaatgttcttcttccaaagacaaaggggttcctttgctgtttgcaagagttgaagagctccctagatgcagtttatgatgtcacaatagcgtataagcatcgcctgccagattttctggatattatatatggcaccgatccttctgaagtccacatccacatcagaactgttaagctctgtgacattccaacgtcagaagatgaagtaaccgattggatgatagagaggttcaggcagaaggaccagcttctgtcagattttttcatgcaaggccacttccctgatgaaggaactgaaggggatgtatccacaccggagtgccttgctaatttcattgcaatagtcagctcgacaggcttcttcttgtacctatctcttttttcgtctgtgtggttcaaggtctatgtattattaagctgcgcttaccttacatttgttacctatttctccattcaaccaccccaactgatatgctcatcagagggtggaacccatgccaaaaaggtactgtagaaagaggctgtagctttgactggaaactgttag

SEQ ID NO: 3587 - DNA, 1388 bp, Hordeum vulgare
ctatccatccgccacaagacaccacaagccccgccgcctccgtcgccgtcgtcgccgcccgatccaaccgcccgccggcccgccagcccccacgcaccgggtcagggaacccgcctgcaaagagataatcgccatgagctcgctctgcccgttcgcgaaggccaccaccggcggcgtgtgccccatgaaatccgacaagaagcccgacaagagcggcggcgctgctgcgtgccccgtgacgggcaagactcatggcggcgaggacaaggagaccggcgccgaccgcgccgccgctggagaagagggcgcagaaggggaccctcgcctggtgcctgcaaagtgccccttcggatacgactccaacactttcaagctcgggcccctcagctgcatggtctgccaggccctgctccacgacgccagcaaatgcaagccgtgcgcgcataagttctgcaaggcgtgcatatcgcgctttaaggactgcccgttgtgcggtgctgacatagaggggttcgagccggatgccgagctccaggccctcgtcgatcgcttcattgacggccatgcccgaatcaagagatcgcttgctggaggggatggccaagctgcggatggcaagagcaaagtgatatatgaggatgtctccatggagagaggcgctttcctagtgcaacaagccatgagggctttccgcgcacagaacattgaaagtgcaaagtcgaggctcagtatgtgtgcagaagacatcagggaggagttgaaatcttcagaagataacctagacctatgttctcagcttggggcagtgttgggaatgcttggggattgctgtcggaccttgggagatgcgccctcagcgattaaatactacgaagaaagtgctgagcttctgtcgaaattgcccaaaaaggatcttgagttggtccatacgctctcagtttcgcttaacaaagttggagaccttcgctactatgatggggacctacaatccgcaagaagttattatgcccgttcattagatgttcgcagaaattcagtgaaggaacactcagctgtggcctcccaggtcattgatctagcaacttctctagccaaagttgcggatgttgacagaaacctcggtaacgaagatgcggctgtcgagggctttgaggaagccatcaagtgcctggagaagttgaagctagaatctgagcaggctggcctagaacaaaggcggcgctcggttctcgatttcctgcagaagcaattgcatgaaaagtaacatggatgggcccagcgtgcactatccataacgaggttcagccgcatcgttgttgtgttgcaatatggaagttgttgtggtgcataagggaggagggaggtgctccagaaatggtgtcttgtgt

SEQ ID NO: 3588 - DNA, 1279 bp, Zea mays
aggatttctctaggatagcagccgccatcacctcctcgcctcgccgcgctccgctggtgctgctgggtcgctgctgagcggagcgggaatcggaccggactcggttcgaattcgtcctcaccttttcgtcgttctgatgccagaagccgagtggaatgatgaacacactaggattgtctgcgaactctttgaagaacaagttcgggctgggaacaggccaaacacgcatctgaacaacattggttaccgccaagttgcggctaagtttcagcagaggacagagcttctctatacaaaattgcagcttaagaacaaatgggacaagtttaagaatgattacatcacctggaggaagttgcttgtagtagggaagggtttaccctgggacacagcaaaggggacatttgttgctgacgaagaatggtggaagaagatcaataaggagctgccgggtgcaaggaaatttcgacatggcggtctacatcatgaggataagttgaatgtaatgtttgactacatcaccagtaatggtgtggatccttcaccgccagctccggaaagcccgaagaatggggtgaatcattcgccaccggctgcaactggtttgccatctgctccagactgcacgctcaatggagtggatcattcgcctgtgactgcacatggtttgccatctggtccatacagccccatgaatgggatggatcagttgccactacccacacatgatttgcgaagtgttcaagaaatccccatgaatggtgtgaacctcgatggattggacaacaacactgaagataatgatgacatttatcaagagcctgtgtttcagtatacttcaaacaggaagaagagaccgattagtttcagtgctacaaagaagaacaagaaaaacaaggctgaaactgctctgctcatgcaagctcatttgtatcgcataactgagctggctcagaaagcacaggatactttcaaaaagtttagctcccaagctgacttggtgccatggcctagcatccaggatgttatgacacttgtctgggaatgcggagcacggtgtggaagcaatgagcatttcatcgcaactgaactgtttgtcagtagagaacagagggagatgttcctgaccatggaaacggccgaggaacgattccagtggcttcgaagaaagtacattgtcaagtatttgtcaggtacaacgagtacaaatctgggtactagataaaatgatcctgggcatttgcattagattttctcccatgtctgttaggctctgttt

SEQ ID NO: 3589 - DNA, 2041 bp, Zea mays
gtactcctatattaggctcgctccggaaggcgagcaggcccctcccctcgccctcgccctcgcccccgtccgccgccgagtgtttgggaagcgagcaagccgctcctccccatccttgttctacgattgccccgcgcgcatcccattcccacgtcgaagcggccgaggtagtcccggctgttgccagcgagcgatggcgagcaacggcatgtcgcttgtgcatcgagccgccgaggcggtgcgccgcacgccgcgatggaagaagaggctcgtcttattcgccgtcggagctagcaccttaacttacgcttgtcaagacaatcgagttcttcaaatttgtgatgggactggaaacaagaagaaggtggttatccttggtacaggatgggcaggtgcaagtttcttgagaaatatcgacacatctttgtatgatgtccatgtggtatcacctcgcaattacttcaccttcactcctttgttgccaagtgtgacatgtggcacagttgaagcacgtagtattgtggagccaattcgcaatattgtgagaaagagaaatggttcatttcgattttgggaggctgaatgcatcaagattgatccaagaaacaaaaaagtccattgcagatcagatgttgggacaaacattaatggaaacggtgaatttgttgtggattatgattacctgattgtcagtattggggctagacctaatactttcaacacacctggtgttactgagaattgccatttcctaaaggaagtagaggatgctcaaaagatcaggaagagtgtcatgaaatgttttgaaagagctgcccttccaaatctttctgaggaagagcgaaagaagaaccttcattttgttgttattggtggtggcccaactggggtagaatttgctgcagagttgcacgattttgtgaatgcggacttggcaaagctgtatcctgatgtaaagaagtatgtaaacatttcagtaattgaagcaggaggtcatatccttacaatgtttgacaaaagaatcaccgaatttgctgaagagaagttcaagagggatggcatagatttgaaaacaaattttaaagtcgtgaaggtgtctgataaggatattaccatgaccaatcctgctacaggagaggtcgctgttccttatgggatggcagtttggtcaactggaattggaacccgtcccatcatcttggatttcatgaagcaagttggtcaggagaaccggcgtgtgctagctactgacgagtggcttagggttcaagggtgtgaggatgtatatgctcttggtgattgtgcaacgattgctcaaagaaaagttatggaagatgttgcttccatattccgagtagcagacaaggataactctggcactttaaccgtgaagaaaataaaagatgtccttggggacatatatgagagatacccacaagtggaattgtatcttaaatccaaccaaatgaagagcttccacgagctacttaaagactcagatggtaactccaaggagttgaaagaactgaacatcgaacagttcaaaaaggcccttgctcaagtggactctcaagtcaagatgctcccagcaacggctcaggttgctgcacaagagggaagttacctagccgactgcttcaacagaatgaagacgtgtgaacaatatcctgagggtcctataaggatcagaggtgcagggcgccatcggttcaaacctttcaggtacaggcatctcgggcaattcgctccactgggtggagagcaaactgcttatcaattgccaggtgactgggtgcatgttggacacagcacccaatggctgtggtattctgtctatgcaagcaaacaattcagttggcgcacgaggatgctagtcatatcagactgggggaggcggttcatctttggaagggactccagtagcatatgaattcaaatctcccgattttgtagttcacctgcgttctagatactacttgcatcagttttgctgtcccactatttccgaagcttagcctcgcaaggtttctgataccaaatt

SEQ ID NO: 3590 - DNA, 2230 bp, Zea mays
cccagcggactcctactctgctgcgctccgctccgttccgttccgctcccctcctcgcggcagcaatcgaatgtctcccgacgtagacgccgccgtggcaaccgccgtcgctcccgggggaggctgcggcggtgacggagaggcgggcgccggcacgtcgtcgtccccggcgtccgcggcgaacgggcgagcgttggtgcggtgggaccagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgcgagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaaccagtgagaaagaatgaactgcgtaacttatggcaacatgtgtggaggcggcatgcaatgaattgccagacaaatggatcagaaaataatgcagccagcaatcatattagtgccaacgttgctaatgggtcaaagacaggagaaaacagcgacgaggaaagtgatgcccaaagctttggtagcaagagggatactgaaattcatagtgttgaggcggtacaagatattcgtagagatgaagtggctggctcatccaaaaataacgaactacaaaataagtcttatgatggagtaaacacaaaagtggatgtgtcaaaatataccaatggtgctccaagtggaagtgagaagaatgtgcggtccaaatgccttaacggtattacttctgcaaaggtggctgagcaaattatggataatgccttgaggatcacggatgcaagttcacgccgtccaacaaatcttggcaatggtttggctatgactgagccagcagctgacagaaaatgtcaatcttcggtcatggaaaataatgctgtcacagaaaataaccctggtgataagtcgaagggtgctgcaataggtcatgctgattcttgcccctccgaatttatggtgaccaacttggggaaggaacaccatcttaatggttacaaaaaccaagaattcagggaaaaagatatctttaatcactcgaattcctctgccttttcaagatatggcaataaaaggatagaaccatcaggtgagattcagtttttcccttctccctgcgtcattgggcaagggcatgttaatggcaagaacccagttttccaacccaatggggtgttgctgcctcccaatgaacataatacaggtgagagtacaaggcaagctcgaatttctctggacagtaggacagagggtgctgccatcctgtgttccactagtgccagggaagatgctggtgcaaatagttcttcccatagaaaggacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaagctcccggtaaaccatctcatgttcttattgaacacaaacagtcagaggaaaaccaccagttgcatcattcaagacaaattcttcgggaatcaggagaaccaattgacatggcgagagctcacgtggatcgtgctaaccagactgcaagctgcagccaaggtatctgtaaaggaagtggatgcacatgtagtggtgaagccgatatcaacgcaaacacaatggttgccctagagagtggcaacgagagtggaatccaaaatggtgacaggtcttgccgtgaagctgcgttgatgaagtttcgcatgaaaaggaaagatagatgcttcgagaaaaaagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgtga

SEQ ID NO: 3591 - DNA, 3944 bp, Zea mays
tcaattgaatcagatgctccacgttacgtccacccttgagctcgatggcagaaggaagcagtagccataggaggagtgcattctcccctgggctggctgtgttattatctggcgatgaagctaagattagctcccagaagtcgcacctggtgtcctatcatgacgaaattgggcaccaggctgttgagaggacgatagagcacatctttgatcttcctcacaagtcagtggtccggcctcctggaccaattgacacaggcttcgtgcactcagtggtgaggaatcaagctagaaaatttgatcttgactgggaaaactgcattcggggataccatcgcagcgtcttcattgtggacaaaggtgctgggcagaggaaggtggttcttgatgattcgagcatttgtggtagcttcaggaatgtccggggaccttcacttgttgagagttccgcccctttcagcagtgccagggctaatgcttgtgtgtggaaaggcaaatggatgtatgaggtgacccttgagacgtccggagttcagcagcttggatgggctactctctcttgtcctttcactgatcagaaaggtgttggtgacgctgatgattcatattcctttgatggccggagggtgactaagtggaacaatgacccaaagccatatggccagccatgggcagtaggtgatgtcatcggttgctgcatcaacttggatgcaggagaaatttccttttacaggaacgggacttctcttggtgttgcatttgatggaattcgcagcgtggaacctaagaagggatattatgctgcagtatccctctcggaaggagagcgttgtcatcttaatttcggctcacatccattcaggtatcctgttgatgggtttgatccattagaggcgccaccacgctcttggtcgtttgtcacataccttcttagatgcctgttccggttgctagaagttcacaacctggagaaatctgaatcagcatacttcgagaaactgaggagggtgaaaaaatttgcaccactacaagaactctttggacccatttcagaagggatctgtgcagaaattttcagtgctattgaagcaagccaggggtgccttgagtatattgcctggggctcgttgatcactctactcttagatgttttcagaactcgtgagccgcatgatttctcatgccttgatcaggttcttgaccttttcctccggttcccaggttgcacttcattatttcaggagctcattgtggccctttcttgcatgtgcaaagttgcaccacttgtgttgacagaatgcccatattctgggtcatatccatttttagcgctggtttgccaccttcttaggcataaggatgtaatgtgtttatggtggaaagcagaagatttcgttttctcgtttgaaggcttccttacaaggaagattccaaataagcaggatctacagtgccttgtgccatctgtttggtggcctggttcttctgaggatgaagttagcatgacactgacgatgacaacactctcagatgcaataaaaaagattgaggagatgcatcgtgaactttgcagcttggtaatatgctttattccaccaatgtctacgcctcagcctccaggctctgtatttaggtcctttgtacaaagtttggtgctcaaagctagaggtggagatcataggatggttgtcaatgggactttcaacaacactgtgcttgtttcattgtacacagtaatcctgcatttgttgtctgaaggattttctatggattctgctggatctgcatcatcctctaaagcgaactttgggaatggtgttggatttcttcacaaaggtggaaaacgcaagtttccgacacaattatttttcaggaatgatgcctatcacagtgtaattcctagaatcggtggaccaccaagtattttgatgcatcaccaatttgatgctgtggaaaatgaagtgcagtgggatgaaggctgcatgaatgatgaagagacacgtgttacacacactacagcacagaagccttgttgctgctcagtgacagatgttgctgttggcctaagatacaaagaaactgctaagtatgtgccatcaacttcaaaaggctcatgtaagcctatgcctgaaagatctcctcatgttgctgctgagtgcaatggtagaggtctgagtgatgagatcgaagacaaacctagcacaagtgctcaatcagaaattgaatatggataccaatcactgcatagtcttgaaaacatgccaatggcaactcaatcttcgtcggaaacacttaaagaagaagagctgcttgatgttatgttgttgttatatcatctcggcatctcaccaaattttaggcaggcattttatttcatgtctcagcagtcgcagtccatttctttactagaagaaactgacaggcagatacgagaaaaatcatgctcagagcaagtaaggcgtttgaaagaagcccggaatagctatcacgaggatttggtagattgtgtacggcattgtgtttggtaccgggccacccttttctcccagtggaagcaaaggggaatgtacgcaacttgcatgtgggtcgtggagcttcttttggtccttagtaactcaaatagcatgttccactatgttcctgagttctatgtggaatcactggtggattgtttccatgcactgcgaaggagcgatcctccttttgtttcccctgcattatttctcatgcaagggttggcctcgtttgtcactttggttgtcaagcacttcgatgatacaaggatagtgaaccctgacttgaaagatcttcttcttcaatcaatatcagttctcgtacagtataaagaattcatgcttgttttcgagaacaatcgggaggctataaataaaatgcctagatcactgttatcagcttttgacaacagatcatggattcctgttacaaacatactttcccggttctgcaaaggctcaggatttgcttcctataagaatggtgaatccgcatcatctgcaacttttcaggttctactgagggagacatgtattcatgaacaagagctgttcttttcctttcttaatcgacttttcaatacactcagctggacaatgaccgagttctctatgtccatccgggagatgcaagataaaaaccaggttgctgatttgcagcagaggaagtgcagtgtaatttttgatatctcatgtagccttgcgagaatcttggaattctgtacccgagagattccttgtgcttttctcatgggaccagatatgaatttgcggaggttgactgaattggttgtctttattctcaaccacatcatatcagtagctgatgcagagttctttgacatgacactaagacggccagggcagcatcaagagaaaacaaatcgtactatgatcttggctcctcttgtgggcattatcctcagtcttatggaatgtagcagcacatcagaacgaagggagctaaatgatgtgattgcagtgttcgccagcatggattgccctgccacaatccattttgggctgcagtacctactgagctacaactggagcaatgttcttcgaggggattcatcccttgcaaagctagcgcagcttaaagagttctcccattacttccgacgcattacagcgtccgtggatggtgaagaagaagaccatagcctaaacgcgggcgatgaagacgacgaccacacttgttgcatttgctacaactgtgattccgatgcaacattccagccatgccatcaccggtcctgctttggctgcataagcaggcatctcctgaacaaccagaggtgtttcttctgcaatgcagtggtaacatcggttactagatagccgattcgcgagcgatgcgctgctctactcattgcctctttcggtatcgtgatccgaaggaagatggtgccactgatttgtcttaattag

SEQ ID NO: 3592 - DNA, 934 bp, Zea mays
ttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcaccagcagatgcagatgtggagcagcattccccacttaagctccgtggccatggcggcgcgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctgagcctcctacagccatctcaggaagcaagcggcggcggcggcggcggcgtcatgtcgcgcagcagagaggaacggcgggacgggtagccaactgacagacaacgcacttgaatc

SEQ ID NO: 3593 - DNA, 1420 bp, Zea mays
ggatcctcgccgcagatggaagtctgcgacgaactgcggtcgtttgaagccacaggcgtctaccgcctcgatggcacctgcagcggcgccggagccacttacctcgacccggtccgcctcctcaacgcgtcctaccagcgtttccgcatcgtcccttctgcgtactactcccgaagcttcggcccccagcatcaggaaggcgagccagagatcgagcggcccgagaaaaggaggaaacgcaagcgtaatcagaagccgaagcccagggagctcaatccaatggagcggatcgctgaagcccggcaccaggaagcgaagcctttactattgaacgcacatgaatcactcgttaaggctaaacatctactggagtacatttccaagacaatcaaaggcaatgaacacacacttgatgcgggtagtggttctgagaataatttcgttgagcttgggacctcatggcgggcacctttctatgagatcactctttgcttccagaaaccccatgtcctgggcaatgaggaaggtttctttcatgcccaaaagacatcatttcctctatttaatagcataatcagtgttgaagggactgacgaagctgaaggagaattccgtaataggcgttatattttaccaagaggaagttgcttcttgatggctgacttcaaacgagttagagatctcattccttgtagtccaaatcaagggtataatcttatagttgttgacccgccatgggagaatggatgtgttcggcagaaagaagtgtatcctacactgcccaacaaaaatttcttgtatcttccagtgcaacaactcgcccgtccaactggagcgcttcttgttttgtggattacaaatagggagaaactgcgggcatttgttgagaaaaaactgcttccttcttggggagtggaagattccaccgtgttttattggcttaaggtgaaacctgatggctctctaattggtgatttagacttgttccatcacaggccctatgagtgcttcctccttggctacataaatggtaatgcaaatgctaagcaagggtcaaatttcaagttgttagaaagaagccaagtaatcatgagtgtccccggtgctcactcaaggaaacctccccttgagcaattactttcagaatatattccaggtcctaaaccttcaagatgcatcgagctttttgccagagagttgtttcccagatggacctcttggggaaatgagccgcttcatttccaggataccatgtacttctcggagaaatagttcgatagccaagagcaggatataagtatgtggattctgatgcaactgccacctaaggcaagtggttttgcaatagcattgtaccttgtgtttttcggcctttcttcaggtgatgaaaacgccccatctccagacgagtttgctcgag

SEQ ID NO: 3594 - DNA, 395 bp, Zea mays
ttggctccggatatcgcagcgtggcggtcgctcagttcagtccgccatggaaggtgcagccggccaaatgctcgtcccgatcctcggcatcgttgccgtggccgccgtgaccttctacaccgtcagcttcatggagatgcgagacaaatccttcgaggagctcgacgagaagtactcggacttcgacgagtcaggcgggcgtcagcggcggtctcgccgcagggccgagcgcgacaggaagaagtccaaatgattggccacgccgccatttgtgtccctgctggtttgagaggggactgacgggggatgaagacgcagctgctacttatgaatttttgggttccaagtcatgggtgagtgtgagtgtgagtgtgtgtggttatgaacatctgcct

SEQ ID NO: 3595 - DNA, 2337 bp, Zea mays
aaaggatcccgtcgtcaagtgctggcgccggcgggctggctccctggcaccggcgccgccgccccggacatggccggagcgccgtcgtcgctagcgcgcctcctcctcctcctcctgctagctgccggatgcctcctcccgctggtcgctgacgccgcgcggctcacgctgtccctcgcgcccgccgccgacgcgctcctcaggctcaaggccggcattaaggacgacggcggcgcgctcggcagctggtcccccgacacgagcccctgcgccgacggcgggcccagctggaagggcgtcctgtgcaacaaggacggcgtgcacggcctgcagctcgaggggatgggcctctccggcacgctcgacctgcgcgccctcaccagcctgcccggccccggcctccgcacgctgagcttcatgaacaacgagttcgccggcccgttgcccaacgtcaaagagctcagcggcctccgcgctgtctttctgtccgagaacaagttctccggtgtcatccccgccgacgcgttcgccgggatgggctcgctcaagaaggtggtcctgtccaataacgacttcactggccccatcccggcgtcgctcgccgacgcgcccaggctcctggagctgcgcctcaacgacaacaagtttcagggcaagatcccggacctgaaacaggaggagttgacggaagtcaacctcgcaaacaatgagctcgagggggagatcccggcgagcctcaaatccatgacatcggacatgtttgccggcaacaagaagctttgcggcccgccgctcggtgccaaatgcgaggcccccccgacgccgtcaccaaaggcgcatccgcaggcctccgtcaaagaaggcaccacgccgtcacaagcagcagcagacaccgtggcatccacgggcgcgtcgtcagcagacgacccgaagcaagacgaaggccaggagcccgtcgagggctccatttcgttcggcgtctccgccgcgttgcttggcacgcttttgatcgccggcgtggcgttcatcgcgctgcggaggcggagggggtacaaaaccaagaacttcggcccgaccgcgtcgtcgtctcgcccctcggggccgccaagggtcgagccgcacccgccggcggcaaaggcgcccgccgccgccgggggcgtggcgcacggcggcggcgcggcgcggaaggcggagcaggggcgactgacgttcgtgcgcgacgaccgcggccggttcttcgagctgcaggacctgctcaaggcgacggcggaggtgcttggcgccgccaacctcggcgtgtgctaccgcgccacgctcacgacgggccagtccgtcgtcgtgaagcggttcaaggagatgaaccgggtgggcagggaggacttcgaggagcacatgcggcggctgggccgtctcagccaccccaacctcctcccgctcgtcgcctactactaccgcaaggaggagaagctgctcatccacgactacgtccccaaccggagcttggcgaacctcctccatggcggcggcgagagcggcgggatgaagaaggcggcggtgcactgggcagcgcggctgaagatcgtgaagggcgtggcgcgggcgctcagctacctgtacgacgagctgtgcatgctcacggtgccgcacggccacctcaagtcgtccaacatcctgctcgacgcccaccacgggccgctgctgacggactacgcgctggtgccggtgatgaaccagtcgcacgccgcgcagctcatggtggccttcaagtccccggagcggaagcagttcggccgctcgtccaagaagagcgacgtctggtgcctcggcctgctcatcctcgagatactcactggaaggccgccgacctacgacccgcccaaggcggcggcgccctcaggcgagctgtcgtcgtcccagcagaagccggggccggcggcgggcaacaccgacctggtgaccgtcgtggggtcgacgccggagggcgagtggctgaacaccgtggtggaccgggacctgcggggcgaggaggaggaggacaaggaggagatggtgaagctgatcagggtcggcatggcgtgctgcgagagcaacgtggacaaccggtgggagctcaagaccgccatcgagaggatcgaggagctcaaggcgaaggagcgccccgacgaggagcaagcgacggtgatcgacgaggactacagcgatgttgccctcaactgatcatcgacacgaaccggccgggaatcgatcgatagggagggttgtgcgcaagctgatgatatgagcccaaaatgtgatgacctgcatgcatgccgagaccctaaacattgagatatcact

SEQ ID NO: 3596 - DNA, 755 bp, Zea mays
gaccgatggctgccgccgaggccattgccaggggcgcgctgtcccgctcccgcgtggtggcgaggggactcgtgcacgcggcgcaggtggttggcctggccgtgttcctccgcgccttcgccgagttcccctggactgccgccgcggccccgcccatcctccgcgccgccgcttccttcctcgccccaccgcgcctctacttcctcgccgccaacgtcatcgtggtcgccctcgccacgctcttccgccgcgacgcggcctcatcctcgccgccgggctccagcggcggcgacgcgcagcacccgttcctcgcgttccttggcccggcgctgccgccgatcaccgaggcggaggagccctccgggcaggaggcgccgccggaggtggtgttcgaggacaaggaggcggtgcacgtgaggacgttgcgcgcccagcccccgcggcggagcatgtcggagaagacgggcggcggcggcggcggcggcgcagcgggcagtgcggcgtcgccggagctgcggcgagccaagtcggagaacggcaggcggcggcaacggcggtcgtcgtcgtcggcggcggcggcggcggtggcggagctgggggtggacgacggagaggcgttccggctggcggtcgaggcgttcatcgcgaagcagcagacctggttccaccgcgaggagtccctggtcgcccgtgccgacgccggtggggaagacggcccggcgatcgccggcgccgcggtggcggtgcagtgatga

SEQ ID NO: 3597 - DNA, 1574 bp, Oryza sativa
actgctgaccaacttcagtgtcgggatatccatgtctgaccatcaatttgccggccaaccagatgtgcagtgcctagtttgcacaaggccgtttactttggatgctcaggtgactgatacctttgaagctttagccatatgcagggactgcaaggccacagtacttaacgatgtcgaaagagatgaaataaccagcacttctcatcacacaagacggagaaggcagagatccaggactgcaagtattgattccctggaggacgcattctcgcaggagttctctcagctgatcgacttagcaagaagacaaggtcgtgaaacggatattgattcttcgtcagtcctgccgcaacatgcgtcgtacaatgcgacaccaagccactctcaaagatggcatgcttcagatgacgagagcgacggccttaattatgttgattctgtgtttggtgaaattgaatcaaccatcagttttggtgactatggtgcggattcagacacctccatagaggaacatagtgtatcggcaaggaggaggatttccattcaacttgacaatggaagttacatgaacacagataccgatattgatcccatgaatgctaggctggatcagtgggattcagatgaccaggaagatgtggaagagtctggttttgatgaaacaataaacaccatgacccagcaccagcagcaatcacatgatattcagctaagtggattgagtgaggacgaatctgaagatggtgtatggaattggagcgtggctgtacgtcaaagagcaaacgtgacaaacttgctagaggacatggaagggccagaaatgaggacaacttttgtcgggaatccagatgattatgttgatgcaaggcagttcgagatgctccttgagcaatttgctgaggacaacagttccagaagaggagctccaccagctgctacatcctttattgaaaatctcccctctgtgattatctccacaagtcatcagataaatgatgatgtgatctgtccggtctgcaaagatccaattcctaccagagctagagcaaaacagctaccatgcatgcatctttatcattcatcgtgcatcttgccatggtttagttctagaaatacatgtcctgtctgccgatatgagcttcctacagatgatgcagagtatgaaaggtccaagcaagccacaaccaatgtaagagacattcaggttgtggaagaaaattctgatgaacaagaggtccaggtaactcgtcagatggctgttggtgctatcgaagagactaatacaagtgaacacaatgttcgtgttgatgagcaaccaagcagtgcacgcaggcgcagtggatggctttttattgctgctgctccagtcgtaagccttatcggtttcgctctagttttatgctttacaaatcctgctaggagtggtagaaggcaactgtactgtagatccccaagtgccactgaagtacatgtgggtaccaaaaagagttggtggtctatgttctagaatgttccggcggtacatctgataacaaaatgactatatatggtggtgcgtgattgtttctttagaa

SEQ ID NO: 3598 - DNA, 1994 bp, Oryza sativa
aaaaaatgttgcaggtggaggaggcgctggcggccgtgctgtccgcggcggcggcgagcgcggcggcgcgcgccgccgaggccgtgccgctgcacgacgcgctcgggctcgtcctcgcggaggacgtccgcgcgcccgaccccctccctcccttccgcgcctccatcaaggatgggtacgccgtcgtggcctccgacgggcccggggagtacccggtgattacggagtcgagggccggcgacgacgccctcggcgtggtcgtcacccccggcacggtggcgtatgtcacgaccggagggccgattccggatggtgctgacgccgtcgtgcaagtggaggacacggagcagctcgccggcgcgccggatgggtcgaagagggttaggatattggtgcggccaactcaggggcaggatatacgcaatgtgggatgtgacatacaaaaggattcggtagtgctgaagtctagtgagcacataggtcctgcagaaattgggttacttgcaaccgtgggagtgactactgtcaaggtatatcgtcgaccaaccattgctgtattttctacaggggatgaattagtggagccagccacagcatctctcagtcgtggtcagattcgtgattccaaccgggctatgttaattgctgctgctattcagcacaagtgcaaggtagttgacttgggtattgcaaaagacactgaggaaagtcttaaggagcatatggatgcagctctaagttctgatgctgatatcattcttacttctggtggtgtttccatgggcgatagggatcttgtcaaaccttgtttggcaagcatggggaaaattcactttgaaaagattcggatgaaaccagggaaaccattaacatttgctgagatcgtaacagaagattcatcaaaaccatctaaaaaggttcttgcatttgggttgcctggaaacccagtgagttgtgttgtttgcttcaatctctttgttgttcctgcaatacgttcactctctggctggtcaaatcctcatctaccaagagtgcacgcacgtctactgcatcctttaagaggagacccacatcgtcaagagttccatcgtgcagtgatcagatgggtgcctgatgatggatctggtagacctggatatgttgctgaaagcacgggccaacaagctagtagccgcctcctaagtatgaaatctgcgaatgctttactggaagtaccattagtggggcagatgttggaggctggaacatctatgcaagctatacttatttctgatatgaccagttcaccttttgacaagctacccactgcttcaaatccgttgccatctcatttatttccttctgcaaaaagtgtttccacagatttgtctcaggttccagcctcacagaatactgaagttaaagtagcaattctgacagtgagcgacactgtttcattgggtgcaggccctgacaggagtgggccaagggcaatatctgtagtgaattcttcatcagagaaattgggtggagcgactgttgttgctactgctgttgttccagacgatgtggaaaaaatcaagaacattttggtgaagtggagtgacattgatcgtgtcagcctcatcttgacactaggtggtactggtttcacacctagagatgtcacaccagaggcaacaaaatctgtcatagagaaagaagcacctggcctcacatatgtcatgcttcaggaaagtttgaaggtgacaccattcgcaatgctatctagagccactgcggggatcagaggatcaacacttatcatcaacatgcccgggaacccgaacgccgttgcggagtgcatggaggcgcttcttccagcactgaaacacgccctgaagcagataaagggtgataagagggagaagcacccgcgccatgtccctcacgctgaagctgcgcctgtggaccagtgggatcggagtttccgagccgcgtcgtccggcaggggatgctcgtgcgagccatgatga

SEQ ID NO: 3599 - DNA, 6561 bp, Oryza sativa
ttctgatctgctcagctaaagggggttgcagctaaacatggcggcggcattagcatggcggttcaatggaaccaatggaggcgcagatctggaacacaaagttcaagagtcagagccaccaactcctgtctcagtgatgagaatggtcaagaaccgtgccaatgtggaggatgaggagacactttcaagtgttgctcaatgtattgagcagttaaggcaaggttcttcatccacccaagagaaagagaactccctgaagcagttattggatcttcttgaaacaagagacaccacatttggagctgttggatcacatgcacaggctgtccctatacttgtttctctccttagatctggttcatctggtgttaagatgctggctgctactgtcctggggtctctttgcaaggaagaggagctaagggtgaaggttctgcttggtggttgcatccctcccttgcttgctcttctcaggtccaagtcagctgaaagccaaactgcagctgccaaaactatttatgctgtttctcaaggtggtataagagaccatgttggatcaaagattttctcaacagaaaatgttgttcctgtactgtgggagcagctcaaagttagcctcaagaatgagagtttagtggatggcctgctaactggagcattgaagaatttatcaaaaaacactgatgggttttggtcagctactgtgcaatgtggtggagttgatatacttataaagctggttgcttctggacaagcaaataccctagcaaatgcatgcaatcttcttggggctttgatgatggaagactcatctgtttgttctaaagttctatcgggagaaacaacaaaacaactcctaaagttacttggtcctggtaatgaaacttacattagagctgaagctgctggtgctctcaaatccctttctgcacagagtaaagaagcccggcgccagatagctaattctaatggaattcctgctcttataaatgctactattgctccatcaaaagagttcatgcaaggtgaatctgctcaggcattgcaagaaaatgctatgtgtgcattggcaaatatatctggtggtttatcttatgtaatatcaagccttggtgaaagtctagaatcatgctcttcacctgcacagattgctgacactgttggtgcattagcctcagccttgatgatatatgacactaattcagaatctatcagtgcttcagaccccctagtcgttgagaaaacactgatgaaacaatttaagcctaaggcaccattccttgtacaggaacgtgtgattgaagctttggccagcttgtacagtaatccagttctctgcaggacacttgcagattctgatgcaaaacgcttgcttgttggtttgataaccatggcaggtactgaggttcaagatgacctcaccaaatcactttttgctctctgcaagaaggattgtgatctatggcaagctctgcaaggtcgtgaaggtgttcagctcttgatttctttacttggtctttcctcagaacagcagcaggaatgtgctgttgctttgcttgcgcttctgtcaaaggagaatgatgagagcaaatgggctatcacagctgctggtggcattcctcctcttgttcagattttagaaactgggtctcccaaagctaaagaagattcagcaaccatccttggcaatttgtgcaaccacagtgaagacatacgggcatgtgttgaaagtgctgatgctgtgcctgctttactatggcttctgaaaaatggaagtgacaatggaaaggagatagcatctaaaacactgaatcatctcattcacaaatcagatacaggaactattagtcagttgtctgctcttttaactagtgaacaacctgaatcaaaagtttatgttctggatgctttgaaaagcttgctttctgtggcaccccttaatgatattctgcatgaaggaagtgctgcaaatgatgcagttgagactatgatcaaaattctcaactcacctaaagaagaaactcaggctaaatcagcatctgctcttgctggactgtttcattgtcgcaaggacttgcgagaaactcatattgcagtgaagacactttggtcagtcatgaagctgattgatgtgcagacagataaaatactaatggcggcctcatcctgccttgctgccatttttctgtcaatcaagcaaaataaggatgttgctgcaattgggcgggatgcattagctccacttgtctcacttgcaaattctacagttctagaagtagcagaacaagcgaccagagctttggcaaacctttttcttgatcatgaattatctctgcaagtatcttttgaagaaattatcttccccataacacatgtgcttagagagggatctattgatggaagaactcatgcagcagcagcaatagctcgccttttacagtgccggccaattaaccaacctctttcagatactattaaccgatcaggtgctgtccttgctctagctgggcttttggaagctgctaatggtgaagctgctgcaacatcagaagttgttgatgcgctggtgctattatcaaaaccaaaggtgtcaagtgggcataccaaagctccatggacagttcttgcagaaaatccccacaccatacttcctcttgtgtcatgtgtagcggatgcagcaccttcattgcaagacaaggccatagaagttttatcgaggctctgttctgatcaacatgatattgtgggtggtttggtttcagaaatcccaggctgcatatcatcagttgcacggcgagtcattgggtccaacatgcttaaagttaaagttggtggatgtgctcttcttgtttgcgcagcgaaagagcattgtcagaagcagatagagattctcagtgactcaagcttgtacattcaactaatccattctctagtcagtatgattcatatgacaaacttgccttctgaaaatgggagtggtgaaaacatatcagacattaaaatttctagacactccaaagaaaataacaacagcgatgaaactgtgtgccgcactgctgtaatctcaggtaacatgattccgctatggctgcttgctgtttttgcacgccatgacagcaaaacaagggctgaaattctagaagctggagcagtcgaaatgcttatggagaagatttctcaaaatgcattcctatatgtgggtgaagaagatagcaccgcatgggtctgtgccttacttcttgctttgctatttcaagaaagagagataaatcgatctaatgcagcattgcactcaattcctgtgctctcaaacttgttgaggtcagatgaacaagcatacaggtactttgctgcacaagctttggcaagtctggtttgcaacggtagcagaggaactcttcttgctgttgctaattctggggcggccactggacttatttctttgcttggatgtgctgaggttgatatagctgatcttttggaattatcagaggagttcatgttggttcctaatcctgatcaaattacactggaaaggctttttagagttgatgatatcagggttggcgcaacttccagaaaatctattcctcttcttgttgacctactcaaacccattccagaaagacctggtgctcctttcttggcgttgggtcttctgacacaattagctattgattgccccccaaacatgatgctaatggctgaagctggaatcctagaggcacttaccaaatacttgtcacttagcccacaagatgcaacagaagaagctacaactgatttgttaggcattctttttagttgcgcagaaataaggcacaatgaagcagcacttggtactgttaaccaacttgtggcagtccttcgtctaggaggaagaaattcacgctacagtgctgcgaaggcattagagagcttatttattgcagaccatgtcaggaacagtgagtcagctcgccaggctattcaaccacttgtagaaattctgagtactggcatggagagggagcagcatgcagctacatcagcacttgttaggctgctttctgacaatccatcaagagcacttacggttgcagatgttgagatgaatgcagtggatgtcctgtgccggattctttcttcggattcttcagctgagttgaaaggagatgctgctgaactatgctgtgtgctatttgcaaatacaaggatccgctctacatcagctgcagcccggtgtgtggagcctttggttgctttactcgtttgtgaagctaacccagcccagctttctgtagtccgtgcactggacaggcttctagatgatgagcaactagcagaattagttgcggcccatggggcagtcattcctcttgttggccttttgtttggcaaaaactacacgctccatgaggcagttgctagagctttggtaaaacttggaaaggataggccaggttgcaaattggaaatggtcaaggctggtgtaattgagagcattctagatattctgcatgatgctccagatttcctttgcattgctttggcagaaatgcttcggattttgacaaacaatgctagcatagctaaaggtccatcggcagccaaagtagtccagccccttttctctttactatccaaggcagatattggtcctgaggggcagtacagcactttgcaggttcttgtgaatattttagagcatcctgaatgccgtgctgattacaatttgacaccccggcaaactattgagccagtcatttctttactgaattcctctccgcctgctgtccaacaattagctgcagaactcctatcacatcttattctagaagagaacctccagaaggacacaataacggagttggccatccctcctctaattcaagttctttcatcgggtttgccaaacttgcagcaaagggctataaaagctcttgctaaccttgcattagcttggccaaatacgattgcaaaggagggtggtgtttttgagctgtccaaggtgttgttgcaatctgaccctcctttgcctcatgttgtatgggaatctgctgcatctgtcttgtctagcatattgcagtacagtactgagtttttccttgaggtgcctgttgcagtactagtgcagttactcagatcaggaacagaaagtactgtcgttggtgcactgaatgcattgcttgtattggagagtgatgattcgacaagtgcggaggcaatggctgagagtggtgctgtggaagctttgctggatctcttgaggagtcatcagtgtgaggaagctgctgccagactcattgaagcacttctgaacaatgtaagaataagggaggcgaaggctgctaaaaatgctattgcacctttgtccatgtaccttctggatcctcagacacaatctcaacaaggaaggttgcttgctgctcttgctcttggagatcttttccaaaatgagggtcttgctcgttctactgatgctgttgccgcatgccgtgctctagtaaatcttcttgaagaccagccaactgaagagatgaaagtggtagccatttgtgccttgcagaatctagtgatgtatagccgagcaaataagagggcagttgcagaatcgggtggcgtccaggttctgctggatcttatcagttcaagcaatcctgatacctctgttcaggcagctatgtttgttaaacttctattcaataaccacactatccaagagtatgccactagtgaaacagtcagagttataactgcttcaattgagaaggacatatgggcatctgggagtgctaatgaggagtatcttaaggctcttaacgctctacttagtaacttccctcgcttaagggtcactgaacctgctaccttatgcattcctcatcttgtaacatctctcaagactggttctgaggcaacccaggaagctgcactggactcactgtatcttcttagacaagcatggggagcttgtgcagcagaaatatttaaagctcagtcagttgctgcctcagaggctattccgctacttcagtacttgatacagtctggcccacctcggttccaagaaaaggcagaattgcttcttcagtgcttgcctggtactttgacagttactataaagcgtggcaacaatctaaggcaatcagttggaaatcctagcgcattttgcaagcttactcttggaaataatccgccaaggctgacaaagattgtctcaactggtgcaacacctgaatgggatgaagcctttgcgtgggcgtttgacagccctccaaaggggcagaagcttcatatctcctgcaaaaacaatagcaaattcggaaagaaatcatttggtaaggtgacaatccagatcgatcgggttgtcatgctgggctccgttgctggcgaatacaccttgctaccagagagtaaaagcggtcctaataggaacctggaaattgaattccaatggtcaaacaaatgacaagtatctacatagttaggttatctgtgtaagttaaaatccataagaagttgagagagtgttcttgttttccatactctgctataaacgttaccatatttgtgcatcag

SEQ ID NO: 3600 - DNA, 2525 bp, Oryza sativa
aacgaaccactcttctgcatcgctttgtacgattcgcccgagcctggatcccgccttcattgacgcgcccgctgtccgggaacaccatgatgtcgaggtttatgcaaatagggaagagcagaaaactagttcatgatgtattggttaactcgaaacccaatagtttcactgcacataacattggatccaactttgcgttcggtttggcacatacaggcagggcctgtttgcacgggaaggttccgcatggaccgggcacgtcatccatgcttggaagagcaaaggagagtttataccggaatccagctgcaagaaacttttcagttctctcaacatgtagccagaatgcatttcatggtcaacttgcttggaagcaactcatgacaatcggttctcatgtaccaaaggcatctccgattttaagtagggttgcttgtgccattagcttggctgccactagatctaatttagttccttacctctttgctttcgttgctggggagataatgctagctcagaagaccagtgcagacggagagtacttaccaattcgtgatagtctttacacgcgtgctcaagatggtcgtatctatgtcacctccttgatattttcagcagtagagctggtcatcataatcttcagatcaatatatttggcattgttgttcactccaagtatactcatggccccatttgcagatactcttggcagtaagtacaggaaaacatggctccgtcttgtgcatcgtaccctggagaaagcaggtcctgcatttattaaatggggccaatgggctgctactcgccctgatttatttgaaagtgacctctgtgctgaattgtcaaaactacacacaaaagcacctgctcacagctttgcttataccaagaagactgttgagaaagcttttggtcgaaagctatctgatctttttgagaattttgaagaagagcctgttgcttctggaagtgttgctcaagtgcaccgagctggtttgagattccggtatcctggccagcatataaagcgtgtaacagttgctgtaaaagtaagacatcctggcgtaggagaatcaatacggagggatttcactatcattaatgcagtagctaaaatttctagatatattcctacattgaattggttgcggctggatgagagtgtgcaacagtttgctgtctttatgatgtctcaagttgaccttgcaagggaagctgctcatttgagccggtttatctacaacttccgaaggtggaaggatgtgtcttttccaaaacctctttacccacttgttcatcctgctgtattggttgaaacttatgagcaaggtgagagtgttgcacactatgtcgatgacctcgatggacatgatcgaattaaaagcgcccttgcacatattggcactcatgctctcctgaaaatgcttctggttgataactttgttcatgcggatatgcaccctggaaatattttggtccgtgttatacaaccaaggaattcaaataacacccttttgaagtctaggccacatgtagtattccttgatgtaggaatgactgctgaactttcaagtaatgatcgtgtgaatttactggaatttttcaaggctgttgcacgccgagatggtcgtacagctgcagaacgtacactgaggttatcaaaacagcaaaactgcccaaatccaaaagccttcattgaggaagttgaacggtcgttttccttttggggaacctctgaaggtgatgctgtccacccagctgagtgtatgcaccagttgcttgagcaagtacggcgccataaagtaaacattgatgggaacgtttgtactgttatggtcactacattagttcttgagggctggcagcgcaagttggatccagattacaatgttatgaaaacattacaaactttactttttaaggaagactgggccaagtctcttcagtacacaatcgaagggcttatggcaccttagggatgcattggaatccactaaaaaattttgaccccttttttgcgcagttgatgagatattggaggatgctccttcgcaccagtacatctagtttctttttcctgtttacttttaaattccacagttttgtacccatcttggccagtgctgcttaaacggccatgtctaattaataattgcagcattttttcaagctaccagagaagtgtgctctggacccacaataccctgggattatctgcttatgcactctgcaggccaaaggatgcgttctcctccatgaaatttctgttaatagctcttagaagatgtagcaaaaggccttcgctgatgatctttttgtaactcgagaggtgtcagtgaacaagaggttttttattgtatacacagatacagctaactgttccaaaaaaaacctacgtcatgcctgacaaaattcatggattgcccatataactgagtgctttcgcatttgtttggaatgcagaagacttaactgtacaaatgtttgctggtaagcaggcatagagtttatttccaggttgcttc

SEQ ID NO: 3601 - DNA, 3594 bp, Zea mays
aaaggtacccgaggtcgtcacgcacagatttaagtgagcccaaacccgcggagtctcatccgttcatcccaccggttcgttcgtcttcctgcatcagccctgagcgtttaattgcgccgccgcctccttgtccttcgcccaagtctcgccgagcaatgcggcctctcgcgctgctcgttctcgcccacctcgccgccctcgcggcggcggcggaggccaagggcggcgtggcgggggcggggctgggcgacgacgtgctggggctgatcgtgttcaaggccgacgtgtcggaccccgacggccgcctcgcgacgtggagcgaggacgacgagcggccctgcgcctgggacggcgtcacctgcgacgcgcgcaccggccgcgtctccgcgctctccctcgccggcttcggcctctccggcaagctcggccggggcctcctccgcctcgaggcgctccagtcgctctccctcgcccgcaacaacctctccggcgacgtccccgccgacctcgcccgcctcccggcgctccagacgctggacctcagcgccaacgccttcgccggcgccgtcccggaggggctcttcggccggtgccgctccctccgcgacgtctcgctcgccaacaacgccttctccggcggcatcccgcgggacgtcgccgcgtgcgccacgctcgcgtcgctcaacctctcctccaaccgcctggacggcgcgctgcccagcgacatttggtccctcaacgcgctgcgcacgctggacatctcgggtaatgccgtcaccggcgacctgccgatcggtatcagcaggatgtttaaccttcgggagcttaacctgcgaggcaaccgtctcactggtagcctcccggacgacattggggactgcccgctgctcaggtcagtggatcttgggtccaactcgctgtccggcaacttacctgagtccctgaggaggctctccacctgcacataccttgatttgagctcaaatgagttcactgggagtgtcccgacatggtttggagaaatgacaagcctggaaatgctggatttgtcggggaacaggttgtctggcgagatcccggggtctattggtgggttgatgtcactgagggagctgaggttgtcagggaatgggttcaccggagccttacctgaatcaattggtggatgcaagagcctaatgcatgttgatgtcagctggaattctcttacgggtgcactgcctacctgggttctcagttccagtgtgcaatgggtgtcggtgtcgcagaacacattgagcggggacctaaaaatgcctgcaaatgcttcttcagtgcttcaaggagtggacttgtcaaacaatgccttctctggagttataccatcggaaatctcgaagctgcagaacttgcaatcattgaacatgtcatggaactcaatgcatggaagtattccggccagcattttggagatgaagtcactggaagttcttgattttactgccaaccgactaaatgggtgcattccagcttcaaaaggaggggagtcattgaaggagttgaggctggggaagaacttcctgactggcaacatcccagctcagattggcaattgctctgccctcgcatcactgtaagtttaagcacttctttctgatccaatccagtggatggataaatgtttggagctttacatgctaaacctccgcattctctggtatatgctcacttggttactatctcttgcagggatctttctcataacagtttaacaggagtcattccggaaacactatctaaccttaccaatctcgagattgtggatctttctcagaacaagcttactggtgttctcccaaagcagctttctaatctcccccacctcttgcaattcaatgtttcacataaccagctctctggggatctccctcccggtagcttctttgacaccatccccctatcttgtgtgtcggataatcctggcctttgtggcgcgaagctcaattcatcttgtcctggtgtgctaccaaaaccaatcgtgctgaacccaaacacttcttccgatccaatatcaccaaccgagcttgtgcctgatggtggtcgccatcataagaaaaccatactcagcatctcggcccttgttgcaattggtgctgctgttctaatagctgttggtgtcattaccatcactgttcttaatcttcgagtgcgtgcccctggatctcattctggtgctgtcctggaactctcggatggatatctcagccagtcgccaacaaccgacatgaacgcagggaagcttgtcatgttcggaggaggaaatccagagttcagtgccagcacccatgctcttctgaacaaggactgcgagcttgggcgtggtggttttggcactgtctacaagaccactcttcgagatggacaacctgttgccatcaagaagctcactgtgtcaagcttggttaaatctcaagttgaatttgagagagaagtgaagatgctgggcaagctacgccatcgcaacctagttgcgctaaagggatattactggacgccgtcgcttcagcttctcatttatgagtttgtctccgggggcaacctgcacaagcaattgcacgaatcatccaccacaaactgcctgccatggaaggagagatttgacatagtcctcggtatagcgagaagccttgctcatctccacaggcatgatattatccactacaatctgaaatcaagcaacatcctgctcgacggatcaggcgaggcaaaggtaggagattatgggctagcgaagctgcttccaatgctggaccgctacgtcttaagtagcaaggtgcagagcgcgcttgggtacatggctccagagtttgcgtgcaggaccgtgaagatcacggagaaatgcgacgtgtacgggttcggcgtccttatcctcgagatcctgacagggaggacgcccgtggagtacatggaggacgacgtggtcgtgctctgcgatgtggtgagggcggctctggacgaaggcaaggtggaagagtgcgtcgacgagaggctctgcggcaagtttccgctggaggaggccgttccgatcatgaagctgggtctggtctgcacttcccaggttccgtctaacaggccagacatgggtgaggtggtgaacatacttgagctgatcagatgcccccaggacagcccggagactgaactgggttaacctcctctactacctacactggatcccggcctgtttgttggtttcacttttgagatccttctctgcttggtaactgaccggacgatgaaaggtgaagcaagcgagttctactctatccagtgtgctgtcgaagtgtctagctagtcttctgatggttagggagttatcatggaacgcctacagtagtttcgtcgcctcccggggtgttgatgtgtttgacttagatcctcaccagtaaggccaagatgtatggcgtggatcctctcacatcaatcctggtggcctgtaatttcaatttaatttttttagctatgcaatgtggtgcaacttgccctttttctagaccatgttatgaaagcttgccacattttggatccttgctgtctaaccacccaggtaccatt

SEQ ID NO: 3602 - DNA, 1019 bp, Zea mays
ctctggcgctctcctatactcttctctctctctcgctcgctgcctgccaggcaggcgggggcagcctttcctccccggtcgccatcctcgtttatatacacacataccctctcttgccgaaccactgctcgcttctctgccggcttctgcttgagtcgtgccagtgacccgtgaccgcgagcttgagggatcgacgcgggcggcggcgatcatggcgtggcgcggcccgctcggagccggagaggaggccctggacagcggcctcgagctcagcctcggcctcccggcatacttcgcccggccttcaggtttggacgccgccagggaggagtccggcgaggcctctgccttcgctatccaggccgccagtgggagcaatggctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtact

SEQ ID NO: 3603 - DNA, 2801 bp, Hordeum vulgare
tggggatggcggaggtgtccgcggcggcggcgccggtgccggagggcgtcctgcacaggaggatagagttccaccccgccaggaggccgcacgccgcggtggccgtcgggggaggcgggttccagatggagaccctcaacccggatgccgccgatggggcggcggcggcggcggggggtgcggccaggggcgaggcggaggcgcggaggccggagaaggccgaggctctgggcttggatccggagctcaccgtcgccaggatctacctcgggagaatcggtgctggtctgcaaaatcttgggaacacttgctacctcaactcggttctgcaatgcttgacgtacaccgagccgttcgcagcctacttgcagagtggaaggcacgagtcttcatgccgtactgctggattttgtgcactgtgtgctcttcagaaccatgttaagactgcgctacagtcaactggaaaaatagtgactccatcacaaattgtgaagaacttgcgctgcatttctcgtagcttccgtaattcgaggcaggaagatgctcatgagttaatggttaacttgcttgaatcaatgcataaatgctgtttaccttctggagtaccgagtgagtctgcaagtgctcatgagaagagcttagttcacaaaatatttggtggccgcctaagaagtcaggtgaaatgcacaaggtgctcgcattgttccaacacatttgatcctttcttggatctcagtcttgatattggcaaggccacaactttggtgagagcacttcagaattttaccgaggatgaactacttgatggcggtcaaaagcagtatcagtgcgagcgctgcaggcagaaagttgtagcaaagaaaaggttcacaattgatagggctccaaatgttttgacagttcatctgaagcgctttagccctttccgtccccgtgaaaagattgacaaaaaagtggattttcaacctgttctagacttgaaaccatttatgagtgattctaaaggcgcaaattacaaatacagtctttatggtgtcttggttcatgctggttggagcactcaatctggtcattattattgctttgttcggacttccagcgggatgtggcacaatcttgatgataatcaggtacgccaagttcgtgagccagacgtactgaaacagaaagcctatatgttattttatgtacgtgacagaattgggaacacattggggtgcaaagacaacatcactcctaatctgcctgtaaacaaagtgattcctgggaagatttcatctatcaatggtgcaatccgaagtggtgtaatggaagcaaaatcgagtggtctgacatctccttatgcaaataagaagttgcagagtacaagcaacgcccattctagcgttagcaatatgactttagtagaccattgttcaacaaatgatggcaaagctgaaactgctgcagcccctcaaaacagtgtcctgcctgccgcacagaaagcccttggacctcaaaatgatggtgttacattgtcaactaagtcaaagcaagttgcttcaagtaatcataaagagacatcttcatcaggtcaaccggcgagcagcaatcagacaatggctaagatgtcattgcaggaaccaaaggctggtggtgcatttgccaagctgggaaacaatacttctattgtctcatctatggtcagtggtcctgctggactgtcagagacagataaacaaacttcttgcgctcaaacatgttccaagccaagcttgaacttggttggcacgattaccgggtttaccacacaaactttccaaactaaggatgctgttgtttcaaatggtgtgatccctagcaccagcggtggaggtccagtttccagtgagaaaatgaaggacttaacaggatctctcaagcaagatgaccacacggtgaaggctttgacgacgagcaaggagaaaaccctactaccaggacttgagcaagttgatgtcggaaaacagatctcctcgcaagtttccacaaaagtggttccaggcgattcatgtaatggcagaatgactaaaagggtggactggaagtcaaagaaacttgtgagatatccagtaattaagttgtggcttcggccaagacaattgccactaaagcaacaaaagaagaagcataagagaaccaaaaagcacgctatagtcaaggacacgaccagtgttgattgttctggtgacaacagcagtgagcagcagacatcaacatcagcaactgtgccgcccaaaactgcagaatctacatctcgtaagcggaaacattcccatgctagtgtaagttctgaaaatgacaccaaagcattcaaagatagccagcaggttgttggagcaagtagtgctggtgctggtgatcataacatggacaccaggaacagtaagagtggaacttctgctagcacagggcttccaaagttgggctcaagctcttctgcaaatcaagcacattcaagaaacaacggagatgcaaagaggcaagtcgttattcacacagaggacttgagggcggaagttactgttccatgctgggatgatgttgccgtgccaaacaccgagactatagagtacagaagttcagggaagaagagcattggatatgtgctggatgagtgggatgaggagtacgaccgtggaaaggcaaagaaggtcagaaaagcgaaggaagacgaggacgacgacggcacgaaccccttccaggctgaggcaaaccacgtatcagcgcgaaaggagaaacaaagaccttggagcaagccggccagaccacgtcgctagtag

SEQ ID NO: 3604 - DNA, 1026 bp, Hordeum vulgare
tccactataagcaacgcaccgacgccccccgacaacgagccatgaccccgccgtcgcccccatcatgccgccgctcctcctgctcctcctcgccgccctcgccccggtcctctcccacgccgccgccggaggttcctacgacccggcgcgcgtcgcccagatctcctggcgtccaagggcgttcctctacagcggcttcctctcgcacgccgagtgcgaccacctcgtcgagctggccaaggggaggctggagaagtcgatggtggcggacaacgactccgggaagagtgtcatgagcgaggtgcgcacaagctccggcaccttcttgtccaagcgcgaggatgaaattatctctggaattgaaaagcgtgtagctgtttggacatttctccctgaagaaaatgctgagtcaatgcaggttctgcattatgaagttggacagaagtatgacgcccacttcgattattttagtgacaaaaagaacgtgaagcgtggtggtcatcgagttgctactgttcttatgtacctgactgatgtgaagaagggtggagagactgtgttcccagttgctgagggaagagatttacagcacaaggatgaaacgtggtccgagtgcgcaagacatggcctggcagtgaagccaagaaaaggcgacgcgctcctgttcttcagtctccacgttaacgcgacgacagatccgagcagtcttcatgcgagctgcccagtagtcgagggcgagaagtggtctgccacaaaatggatccacgtccggtcattcgacaatcctccagatgttatgacggacgcaccgtgttctgatgccaatgagcaatgccctagatgggctgctcttggggagtgttacaagaacgcaaaatacatggtgggcacgaaggacacactcgggtcgtgccgcaaaagttgcggggtctgcgatgcttgaaccaccccaccaatcttaactgaatttgcatggttactgagacgtagattaccaaaccaagtaggttcttagtagcatggcat

SEQ ID NO: 3605 - DNA, 1645 bp, Hordeum vulgare
cgacctttgataccaagcaagtacagggagcatcatccgtccgaggctcctagtcgatcgcgcaccaaccaaatggagaccccgaccgtcgtgctgctgcccgtctggtccgccggccacctcatgtccatgctcgacgccggcaagcggctgcttgcccgcagcggcggcgggctgtcgctcacggtgctcgtcatgcaggcgccggcggcgaacgacagggccgaggtcgccgcccacatacaaagggaggaggcgtccggcctggacatccgcttccagcacctccccgccgtcgagcccccgacggactgcctgggcatcgaggagttcgtctcccggttcgtgcagctccacgcggcccacgtgaaggcagccatctccggcttggcatgccccgtggccgcgctcgtcgtcgacttcttctgcacaacgatgctcgacgtgtcccgggagctagtcgtgccggcctacgtctacatcacagccgacgccgccttctacgcgctcctcctgcgcttgccggcgctccacgaggaggtcgccgtcgagttcgaggagatggaaggcatggtcggcgtgcctggcctgccgccggtgccgccgtcgtccctcccggttccggtgatggataagaagaaccccaactacacgtggttcgtgtaccacggcaggcgtatcacggaggccaagggcgtcatcattaacacggtcaccgagctggagcagagcgttcttgcagccatcggcgacggccggtgcacgcccggaattcctgccccgacggtctatccagtaggccccgtgctctccttgacgccgccagcggaggagacacacgaatgcgtgcggtggctggacgcgcagcctccggcgtccgtggtgctcctctgtttcggcagtatggggttctccacggcgcctcaggcgcacgagatagcccacggactggagcgcagcgggcagcgcttcctgtgggttctgcgcggcccgccggcagccggtgcgggacccggacagccctcggacgcggacctcggggagctgctcccggaggggttcttggagaggacaaaggagaagggcatggtgtggccgaccaaggctccgcagaaggagatcctggcgcacgcctctgtggggggcttcgtgacgcacggcgggtggaactcgaccctggagagcctgtggttcggcgtgccgatggtgccatggccgctgtacgcggagcagcacctgaacgcgttcacgctggtggcctacatgggcgtggccgtggccatggaggtggacaggaagaggaacaacttcgtcgccgcgtcggagctggagcgggccgtgaaggtgctcatggagcgcgactccgaggaggggaagagggcgagggagaaggccgcggagatgaaggcagcgtgcaggaaggccgtcgaggagggcgggtcctcctactctgccctggggagtctctccgaggagataatcaatggagcgaattagtaattcgagaatgccagggcgttgtggttgcaggctgcagttcttgttcttcctgctgatcattccgggttttgtgccggcatcgcgagcaatccgcatgcggtctctagacctaataaaactccatgctactacaaactaatccgtg

SEQ ID NO: 3606 - DNA, 1493 bp, Hordeum vulgare
taaaaatggcggctgctactccgacgcccacgctggtgctcgtgccggagtggggcgccgggcacctcatgtccatgctcgagtcctgcaagcgcatcctcctctgcggcggcggccgcgccttctccatcacgctgctcgtcatgcgcccgcccaccgccgaggccacctcccaggtcgaggagcacgtccgccgcgaggccgcctccggcctcgacatccgcttccaccgcctccccgccgtcgacctcccgtccgacgccgccggagtcgaggagttcatcgcgcgctacatccagctccacgcgccccacgtccgggacgccgtcgcggggatgtcgtgccccgtcgccgcgctcgtgctcgacctcttcgcggcgcccatggtcgacgtggcccgcgagctgcgcgtgccgtcctacgtcttcatgtcctccaccggcgccatgctcgcgctcatgctccacctgcccgtgctccaccacgtggtcaccgtggagttcgacgaggtggaggacggggaggtgcacgtgcccgggctgccgccgataccgcccgagtccatgccgtgcccggtggtggacaagaagagccccaactacacctggttcgtgcgcctcggcgacagcttcatggacgccacggggatcatcgccaacaccgcggacgggctcgagccggggcccctcgcggccgtcgccgacggccgcgccgtgccaggccgccccgcgccgccggtgtaccccgtcggccccgtgctctcgcttggcagcagcaagaaggattccccggagccaccgcaccagtgcgtcgcctggctggacgcgcagccgccggcgtcggtggtgttcctctgcttcgggagcatgggctggttcgagccggcgcaggtggcggagatcaccgcggcgctggagcggtgcggccaccgcttcctgtgggtcctgcgcggcccgccttcctcccagtccggcgccggcgcgccggacgggtcggagcacccgacggacgcggacctggacgagctgctgccggaggggttcctgcggcggacggagggcaaggggctggtgtggccgacgtgggcgccgcagaaggagatcctggcgcacccggccgtgggggggttcgtgactcacggcgggtggaactcggtgctggagagcctgtggcacggcataccgatggcgccgtggccactctacgcggagcagcacctcaacgcgttcgagctcgtcgccgacatgggcgtcgccgtgccgctcaaggtggaccggaggcggggcaacttcgtggaggcggcggagctggagcgggcggtgaggtgcctgatgggcgaggaggggaggacggccagggagaaggccgccgggatgcgggacgtctgccgcaaggccgtcgacaagggcggctcctccgacgctgcgttgcagaggctctcggaggcgctccaccacggcgcggtggccccgaccatatgaaaccgtgtatga

SEQ ID NO: 3607 - DNA, 1652 bp, Hordeum vulgare
aaaggatccaacacgacttgtgagtgagagctgaagcaagctcgatcgctaggaaggaaggaagtcatggagatagcggggccgctggcgccgggggagaggccgcacgccgtgatgatcccatacccggcgcagggccacgtcacgccgatgctgaagctggccaagctactccacgccaggggcttccacgtcaccttcgtcaacaacgagttcaaccaccgccgcctgctgcgctcccagtccgccgacacgctgcgcggcctgcccgcgttccggttcgccgccatcgccgacggccttccgccgtccgaccgtgaggccacgcaggacatccccgcgctgtgccacgctaccatgaccacctgcctcccacggttcaaggagctcgtcctcaagctcaacgaggaggccgaggcctccggcggcgcgctgccgccggtgacctgcgtggtagccgatagcatcatgagttttagccttcgcgccgcgcgggagctcggcctccgctgcgccacgctctggaccggcagcgcgtgcggtttcatgagctacaaccattacaaggatctagtcgaccgtgggatcttccctctcgaagaagaggcgcagttgagcaatggatacttggaaacgaccatcgactggataccggggatgcccaaggacatgcggctacgtgacctccccacattcttgcgcaccacggacccggatgacatcatgttcaacttcttcgtccatgagacagccgccatgtcgcaggcctcggcggtgatcatcaacacctgggacgagctcgacgcacccctactcgatgccatgtccaagctcctgccgcccatctacacagtggggccgctccatctcacggtgcgcaacaacgtcccggaggagagccccctcgccggcatcgggtccaacctatggaaggagcaggacgcgcccctccggtggctcgacggccggccaccacgctccgtggtgtatgtaaattttgggagcatcgcggtgatgtccaaggagcatatgctggagttcgcgtggggactggccaacaccggctacgccttcctgtggaacgtgcggcctgacctcgtcaagggcgacgacgaggccgcacttccactggaattcaccacggcgacggaggggcggagcatgctgtcgacctggtgcccgcaggagaaggtgctggagcacgaggccgtaggggtcttcctcacgcactccgggtggaactcgtcgctggagggcatctgcggcggcgttccgatggtgtgttggcccttcttcgcggatcagcagaccaactgccgttacaagtgcacggagtggggcatcgggatggagatcggggacgatgttaggaggaccgaggtggaggccctcatacgggaggccatggagggagagaaggcgcgagagatgagacgacgcgtgctggagctccgggagagcgccgtggcctctgcacgtcctggcggaaggtccatgcgcaatgttgatcggctcatccacgaggtgttgctagcctgaaacaagcaaattaagatggtaaaaataaaggatataaggcagaccttcgctgaaaagggatgtttgttggcagttttagttgcgacccaagattaaatgaggcactcgagttt

SEQ ID NO: 3608 - DNA, 2878 bp, Hordeum vulgare; identical to SEQ ID NO: 132

SEQ ID NO: 3609 - DNA, 1755 bp, Hordeum vulgare
cgacccaaattgacataactccgcggcggccggcgcgatgcccgccgcggcattcgcctccgcgctcgcgtctcctcctcctccatgggccccacgaccgtcccctcggcacgctagcctccgcctgcccccgccaaggagcagcggcggcggaggggacaagcccaccacgtcgtgggtcagccccgactggctcacgtcgctgtcccgctcggtgctcggccggggaaacgacgactcggggatccccgtcgcctccgccaagctcgacgacgtgcaggacctcctcgggggcgcgctcttcctcccgctcttcaagtggttccgcgaggaagggcccgtctaccgcctcgccgcggggccgcgcgacttcgtcatcgtcagcgaccccgccgtggccaagcacgtcctccgcgggtacggcacgcggtacgagaaggggctcgtcgccgaggtctccgagttcctctttggctctgggttcgccatcgccgagggagcgctctggacggtgagacgtagagcagttgtaccatctctacacaaaagatttctctcagtaatggttgataaagtgttttgtaaatgtgctgagagattggtggaaaagctcgagacatatgctttgagcggtgaacctgttaatatggaagccagattttctcaaatgacactagatgtgattggtttgtctttgttcaactacaactttgattccctcacatcagatagtcctgttattgatgctgtttacaccgcactgaaagaagcagaggctcgttctacagatcttttaccatactggcagattgatttgctgtgcaagattgttcctagacagatcaaagcagaaaaggcagttaacacaataaggaatactgttgaagagctaattataaaatgcaaggcaatcgtagatgctgaaaatgaacagattgagggtgaagaatatgtaaatgaggcagatcctagcatcctgcgttttttacttgctagccgtgaagaggtcagcagtttgcagttacgtgatgatctattgtcaatgttagttgctggtcacgaaacaacaggctctgtactgacatggactatttatcttctcagtaaggatccagtagcactaaggagagcccaagatgaggtagatcgtgttctacaaggtagactcccaagatatgaagatgtaaaagagctgaagtacttgatgcgctgtatcaatgagtccatgcggctatacccacatcctcctgtgctgatacggcgtgcactagttgatgatgtgcttcctggaaactacaaggttaagactggtcaagatattatgatttctgtgtacaatattcacagatcacctgaggtatgggacagagcagatgaattcattccagagagatttgatttggagggtcccattccaaatgagtcaaacaccgatttcaggtttatccctttcagtggaggtcctcgaaaatgtgttggagatcagtttgctcttttagaagcaattgtggcacttgcaattgtcatacaaaagatggacgttcagcttgtggcagatcaaaaaatcagcatgaccactggggccaccatccatacaaccaatggactgtacatgaatgtaagtctgcgtaaagttgagcaagaagctgacttagcactgagtccatcaggctaggcaaaagcaaagtaaagcagagcagggcgagattagtacagtcagcggcaacagaattgtcaataccaggttccagctat

SEQ ID NO: 3610 - DNA, 1978 bp, Hordeum vulgare
cgagctagggttagggtttcgaggggtttgcgctagggtttggtccgcgatgggccggtcccgcggggtgcccaattccggcgacgacgataccaaccacaggtcgaagcggaggagggtcgcctcgaccggggatgcgtccgactcgctctccgccgcgtgcgggggagccggcgacgggaagaaggcgctctaccactgcaactactgcaacaaggacctgtccgggaagatccggttcaagtgctccaagtgccccgactttgacctctgcgtcgagtgcttctccgttggagctgaggtccagccgcatcggagcaaccacccctacagggtcatggacaacctatcttttcctctcatttgtccagattggaatgcggatgaggaaatccttcttctagagggaattgaaatgtatggtctgggaaactgggctgaagttgcggagcatgttggtaccaagagcaaggcacagtgcattgagcattatactactgcatatatgaactcaccttgttatccccttccggacatgtctcatgttaatggcaagaataggaaggaacttcttgccatggctaaagtacagggtgagagtaaaaaaggaattccactgttatcaggggatttgacacctaaggcagagtcaccgttttctccctccagggtcaagatggaagatgcacttggagaaggcccagccagtcgatcaccttcgcacatacctggcggcgcaaacaagaaagcttcaactgctggtcattttaaagataattccaatctatctaaagtcgaagatggtcatatggatagaagtattggtgtgaaaaaacccagatattctgcagatgaagggccttctttaactgaattgagtgggtacaatgcaaagagacatgagtttgacccagagtatgataatgatgctgaacaagccctcgcagagatggaatttaaagaaactgatacggaaactgatcgtgaactgaagctacgtgtgctgcgtatttacttgtcaaggcttgatgaaaggaaaaggagaaaagagttcatattggaaagaaatttactatatcctaatcctttggagaaggatctaacaaatgaagacaaggaagtttatcatcgatacaaggttttcatgcgtttcctttccaaggaggaacatgaagcacttgttaggagtgttattgaagagcgaaaaatccgtaggaggattcaagagcttcaggaatgtcgttcagctgggtgtcgtacgctggctgaagccaagatacacatagagcaaaagaggagaaaggagtatgaggcgaatgccctgaaagctaaggaaagtggccagcttatttcaaatagtaaatcaggacacaaaacaaaccggcctatgaaagttgagactgatgggagtttggatcttaagaaaggtagtgccattttggatgctggtggtagggattctccaaaaagcacaggaccaacaagcgctaagcaatgggatgattgggacattgttggtcttcctggggcagagctattaagcgtcagcgaaaaacttctgtgctgtcagaacagattgctacccagtcattatctgagaatgcaggaggtgttgatgcaggagatgttcaagggcaacatcgtcaagaaggaagatgcccatgtattgtttaaagttgaccctgccaaagtcgatacggtttacgatatggtgacaaaaaagctgggtaacaacgaggaggctccgatggtttagctatgcaatttgggctctgcctgctctaggcttggcccagaaccaaatcttggtttctcagcacgacggaggcccaggtgagaaaggaggctatacttacatgacttggctgtagcagtgttacattgagatttgtgtcagatttctgaaggaagtgcaataaggcattcgagccaaattgtaaaattacccggcagcgggaatgtgtagcgtgagttgttg

SEQ ID NO: 3611 - DNA, 1511 bp, Hordeum vulgare
ccacgtcctagaatgaaagaggcaaaccaaggagccggcgacagagagtcgcggcgcacagtcgtcatgtaccctgcgcccggcgcgggccatttgatccccacggtggagtttgccaggctgctcgtgtcgcatggcctcgcggtcatcgtcgttcagcgtggccttccggccggcaacgccaccgttcccgcctcctccctgtacggcaacggcgacgcttcagccagcccctttctctctttccactacatcccggagccgccactcccgcacgggatgccggagggcgaccatgtgggcaaggttttcgagctcagccgcgcctccaaccccgagctccgtgatttcctccgcgccaccgccccggcggccctcctgctcgacttcttctgctacagcgccgccgatgtcgcggcagagatcggcatcccgacgtatttcttcttcctgggttgcacggccagccttgcggtactgctccacctgcccgtcatccacgggcaaaacgctgtgaacttgggtgacctcggcggcgagcccgtgaaggtgccgggcgtcactcccataccggcgcacgacctccccgctgctttcctcgaccggagcagcgtgagctacaagcatttcctcgccgtgtcccaacagctgtgccagtcgcatggcgttatcgtcaacagctgccgctccctggagccgcgcgccaccgatgccgtcgccgccggcctctgcgcgcccccggggcgcacgacaccgcctttgttctgcatcggcccggtggtgaagtccgaggaggtggctgagaagcaaggcgaagagtgccttgcgtggctagacacgcagccggaggccagcgtggtgttcctctgcttcggcagtatgggccggttcagcgccgagcagatcaaggagatggcggcggggctggagatgagcgggcagcggttcctctgggtcgtacgcagcccggcgggcggcaacggcaacggcaacgagcatcccggcgagccggagctggacgtgctcctcccggatggcttcctggacaggaccaaggacagagggctggtggtcatgtcgtgggcgccgcagcgggaggtgctcgcccacggatcggtgggcgggttcgtgacccactgcgggtggaactcggtgctggaggcggtcatggcgggcgtgccgatgctggggtggccgctgtacgcggagcagcggatgaacaaagtgttgttggtggagggaatgcagctaggcgtggcggtggaacgaggcgaggatggcttcgtgacggcagaggagatcgagaggaaggtgacttggctgatgggttctgatggcggaagggagcttcgggagcgtactctggcggccatgagaggggcaagggaggccctgagcgacggtggggattccagggcggcactgctgcagctcgtgcaaaggttgagcgcccccgatgtgacggaggagagtgtttgccagctgtagcttgtgcaaccgtgaatgaacag

SEQ ID NO: 3612 - DNA, 1734 bp, Hordeum vulgare
tgagcagcgagccctagctacctggactggactggagtaggcagtgagcagcgagccctagctacctggactggacattggagtaggacagagtaggtacttagttacaccatgacaatggtagcgctggggctctgctcctccttcttctctgtgatggtgatgctggccgtaatgtacgtggtccggaggctgggctccaagtggacgtgctcatccgcacccggggcgctccctccggggccgtgcccgtggccggtggtaggtagcctccccgagctcaagtttaacaagctgcctgcgttccggtggatccatcaggtgatggagaagatggacaccgacatcgcctgcttccgcctcggtggcgtccacgtcatcccgatcacgtgccctcgtatcgccagggaggtgctcaagaagcaggacgagatcttcgcgtcccgcccggagacgttcgcgtcgtgcgtggccagcggaggctacgtggaggcggcgctggcgccgttcggcgtgcagtccaccaagatgcggcgggtgctcacctccgacatcatctccccgtcccgtcacaagtggctccacgacaagcgcgtcgaggaggccgacaacatctcgtggtacatgtacaacctcaccggcggtgaggagggcggcaacgtggacgtaaggcacctctcgcggcactactgcggcaacgtcatacgccggctcctctttggcacgcgctacttcggggaagccggccacggcggcggccccgggaagctggagatggagcacatggacgcctccttcgccgcgcaggggatcctctactccttctgcgtcagcgactacctgccgtcgctgctggggctggacctggacggccacgaaaagattgtcaaggacgctaacgcggtgctggacagactgcatgacggggtcatcgacgagcggtggaagcagtggaaggccggcgagaggggagaggtgcaggacttcctcgacgtgctcatcacacgtagagaccctagattgaccatggaggaggtgaaggcgcaggctaagctcatcaacctggcggcggtggacaacccatccaacgccgcagagtgggcgctggcggagatggtgaagaatccggagctgctggggcgggcggcggaggagctggaccgggtggtggggagggagcggcaggtgcaggagtcggacatcccccaactcaactacgtcaaggcctgcatccgggaggcgttcagactgcaccccatcgcccccttcaacgtgccgcacgtcgccctcgccgacaccgtcgtcgccggctaccgcgtgcccaagggcagccacgtcctcctcagccgcctcggcctcggccggaacccggccatctggaacgacccgctccgcttcaaccccgaccgccatctggaaggagcaggcggcaacctggagctcaccgagaacaagctgcgcttcatctccttcagtacaggccgccgcggctgcgtcgcccccatgctcggcacggcgatgaccgtcatgcttttcggcaggctcctccatggcttcacctggtctaagccggcggagatgccggatattcagctcaccgagtcccacaacgacctctccatggctaagccgctggtgctgcacgccaagccacgcctgccgctgcacctctaccgcccgtgaattcgatcgtcgatctccctcaagttactactccactccctagtagtgtga

SEQ ID NO: 3613 - DNA, 1886 bp, Hordeum vulgare
ctagtagtgttcttcccattcggcctaaacgcgagaacgagggaaaaagtacgtgcacgtacgtcgacatggctccatccgaggagtgcggctggctgctgtacgtttctcttgcagccaaatgctgcgccaacggcgacggcgagccttaccgcgtggtaagctttgttgcagttctgctcgccgccttcgtcgtcacgtcgctcctgcactggtcgtctcaaggtggtgcggcgtgggggaggtattggtggacgaggaagggtctgggcattggcgaggcccgtgtcccggggccacggggcttccccgtgatcggcagcatggggctcatgaccggcctcgcgcaccgtaagctggcggtggcggcgtcaggaaacgtcaggcgccggcggctcatggcgttctccatgggggagactcgggtggtggtgaccgcggaccctgacgtagccagagagctgctggctagccctgcgttcgctgaccggccggtcaaggagtccgcctacgggcttatgttccatcgcgccatcgggttcgccccctacggcgcctactggcgcacgctccgccgcgtgtcgtcctcgcacctcttctcgccgcggcaggtggccgcctccgccgcgcagcgcgcagtgatcgcgcgccagatggtggacgccatgaggcccgtcggcagcgctggcatcaaacacgtcgaggcgcggcggttcctgaaacgcgcgtcgctgcacaacgtgatgtggtccgttttcggtcggaggtacgagctggacgaggtggagagagaggaggccgcggagctcaagagcctggtggatcaaggctacgacctgctcggccagctcaattggtccgaccatctcccgtggctcgcgcgcttcgacctgcagaagatccggtccaagtgctccgccctcgtcccccgcgtgaaccggtttgtcggcaggatcatcgacgagcaccgtgccgcccggaacgacgccgacgccgacgccgtagtagacttcaccgacgttctgctctccctacaaggcagcgacaagctctccgacgccgatatgaccgccgttctctgggagatgatctttcgtggcaccgacaccgtggcagtggtaatcgaatgggtgctggcccggctggtgctgcaccagggcgtgcaggcgagggtccacgaggagctggaccgggtggtcgggccgaaccgggcggtgaccgagtcggacgccgcctcgctcgtctttctgcaggccgtggtcaaggaggtcctgcgccttcacccaccggacccactgctgtcgtgggcgcggcttgccacatcggacgtccacgtaggtgggttacttgtccccgcggggaccacagcgatggtcaacatgtgggccataacccacgacccagccgtgtgggccaagccgggggagttcaagccagaacggttcctcgccgggccattgtccgccgacttctccgtaacgggttccgatctcaggctcgcgccgttcgggtccggcaggcggagctgccccggcaagtcactcgcgatggccaccgtcggattctgggttgccacgctgctgcacgagttcgagtggacgccgccgccgccgtcgtctgccgggccaggtggcgtggacatgtctgaggtgctgaggctgtcgtgtgagatggcagctccgctagaggcgaggctaaggccgaggcgtactgtgtgattacgtgcttgcttggggcagccatgtgagcagttggcctcttcttcccttctgtactactatcagtatcagtgcgtgtagtgtagtggtaatgtagtgtctcgcttttggaaatgtgcccgctactacaataggtccggtcctcgtatgtgtaccgctgtcgtttac

SEQ ID NO: 3614 - DNA, 1619 bp, Hordeum vulgare
cacccatgtccatgcaacaacaacagcaacaaccgacgagtgccaaccttctcggcgccatgcctgcgtcctctatgatcagcatcgccttcacggccgccgtgggtaccgcggtcttattcgtcgccgtcgctgtggcgaggtacaaccggaagtacagggggctgaggctcccgcccggcccgcccgtgtggcccatcgtcggcaacctcttccaggtcgccttctctgggaagctcttcatccactacatccgcgacctgcggcgtgagtacgggcccatcctgacgctgcggatgggggtgcgcacgctcgtcgtcatcagcagcgccgagctcgtgcacgaggcgctcgtcgagaaggggccggagttcgccagccgccccgccgagaacaccacgcgcaacatcttctcctccaacaagttcaccgtcaattccgccgtgtacggcgccgagtggcggtcgttgcgtcggaacatggtgtccgggatgctgagcacgtcgcgtctccgggagttccgcccggcgaggcttcgagccatggaccggttcgtggcacgcatgcgcgccgacgccgtggcctccaccgacgaggcctccgtgtgggtgctccgcaacgcgcgcttcgcggtgttctgcatcctgctcgacatgaccttcggcctgctagacctggacgaggagcacatcgtacacatcgacgccgtcctgaagcgcgtgctgctcgccgtcggcgtgcgcatggatgactacctcccgttcctccgccccttcttctggcggaagcagcgcctggcgctcgccgttcgccgcgagcagatcgacacgctcctcccgctcatcgaccgccgccgcgccatcctccgtgacatgcagcgctcgccgccagatcccaacgtcgccgcgcccttctcgtacctcgactcgctgctcgacctgcacatcgagggccgcgaaggcgcagacgatgagctggtcacgctctgcgcggagctgatcaacggcggcaccgacacaacggccactgccattgagtgggccatggcgcgcatcgtggacaacccgtccatccaggcccggctccacgaggagatcatgcagcaagtcggcgacgcccggccaatcgacgacaaggacatcgagaccatgccgtacctccaggccttcgtcaaggagctcctccgaaagcacccgcccacgtacttttcgctcacccacgccgccgtcaagcctgggagcaagctcgccggctacgacgtgcccacggacgcgaacctggacatcttcctcccgaccatctcggaggaccccaagctgtgggaccgtccgacggagttcgacccggacaggttcctaaccggcggcgagaccgcggacatgacggggtccgcgggcatcaggatgataccgttcggggcggggcggcggatctgcccgggcttggccatggggacgacgcacatcgcgctgatggtggcgcggatgctgcaggagttcgagtggcgcgcgcacccgtcgcagccggcggtggacttcaaggataaggtggagttcacggtggtgatgaaccagccgctgctggccacggtgaagcctcggaagatgtcgctctgatga

SEQ ID NO: 3615 - DNA, 1416 bp, Zea mays
gaggacaccgcttgctttcacggccgacgacctaatccccttccctcccattggcagccgtcgccatgctgcgcgtccgaaatcggctcctccctctgctcggcgccgcctccccgcttccctcccccatccacatccacctccgcgtgtgccgcctcctctccacctccacctctacggccaccgtccccgcacccttctcccttgagaactacctcgtcgccgcctgcggcttcgcacccgcccaagctcgcttggtgtccaagaaggcgttcaacgagttgtccagggaatccaagagatcatcggaggagcactcctgcagacgcctcatctccgcctccaacccagatgccatcctcgcgctgctctccggcgccggcctctcccgcgccgacatcgccgccgtcgtctttgcggacccgctgatcctccgcgcttccgtgagtaaaatcgcaccccgccttgtcgctctccgcgaccgcgtcggcctgtctactccccagatcgctcgcttcctcctggtcggctcacgcgctctccgccggtgcgacgtcgttcccaaggttgagttcttcttgtccttcttgggctcctttgatcgggtactggcggtcgcaaaggcaaacttgggcatcttcaacgcgaaccttgagaaggtaataaagcccaacatagacttgtttcgtcaacgcggcgttcgaaacgtccctaagatctgtctccaccgcccacggacgctttcctttaacctcgaacgcgtgaaggaatttttgctgcgggcagaagaacttggggtgcctgccgcgtcgcccttgttcatgcaagcagtgggagtcgtcaccagttttccccctgagaaggttgctgccaaacttgacttctttaagaggactcttggttgttctgagtctgaggtttcgaatgcagtgtccaagatgccacaaatactagcattgtctgaggcgactcttcttcgcaagatcgagttcctggtcaatgagggggcgatagagccacagtatattatgcaaaggcctatcctgctcgcattcagcttggagaagcggctagtgccccggtatcgtgtcatcaaagtgctgcagggaaagggattgctgaatagcaacatgagcctttcctcattagcttctcttgcagaagaaaccttcaagtccaagttcgtcgactgccacaaggactgtgttcctggccttgcagatgcttatgctgcagcttgtgctagtattgtgccctcgacagtgtaagttaagccgtttcaaaaacaaaaacagtgtaagttaagcttctcattttgtgttttaggtggatgctcattggctgctgtccactctgcaattttgatttctgaagtatataaccactcatgatcactgattggtcatatccaaggtt

SEQ ID NO: 3616 - DNA, 1879 bp, Zea mays
ctgttgccacatctagtggttcggcctttccatctgccgttcgcccagcgtgttctccctctagtgcggcaactgggcgaccgccgccgccgctctactccaggtgcccaggcgttcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctgatatcacaagttcctaatagcaccgccctttatgaacctcttgagataaatgaaaaagaagggtcaaaatcaaactcggatgataaaactgttgagaagctaggttcaacaagtactgaatttgattgtgatttgcttgatatttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaataggttgtggcgtggctggcagggcctgggacgacactatcagacagaatcaaagttgggaatagacagctgaaacaaatgcctcgacaggcttattgaggaataagtattgagattatagtgctgaaataatcgctgaattgtg

SEQ ID NO: 3617 - DNA, 1349 bp, Zea mays
ttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcagcccaccagggccaccacctccctaccgaggaggcaaccccaacgtaccgccatattcgggtggtggcaatcctggctaccctggtggcagccctggctaccagggtcaaggaggcaactcgaacttccagtgaacatgaccacgagtactaagttggcacccctgtttcagagtagccttctgcaagagatggtg

SEQ ID NO: 3618 - DNA, 2091 bp, Zea mays
gcctcatctcggtttactataagagtataagtacgtctccgcaacaagctaatcttttttttgccccctccttccacgtccccaccctgccgtcgtcgctactcgcatagagattcgcgcggccgtgtcttgctcgcgcctgcccccttccttccttgtcgtgccagcgcccagatctctcgctcgccggcgctcgggccagatctgggtgggggctcggaggcggagccgggcgcaggtttggtttgacccaaggggcgaggaggagagggaagaagaccccggacgccatggagctggcggttggcggcgggatgcggcggtcggcgtcgcacacctcgctgtcggagtcggatgactttgagctcacgcggctgctcagtaagccgcggatcaacgtcgagcgccagcgctccttcgacgaccactctctcagcgacgtctcgcactccggcggatacggcaggggtggcttcgacggcatgtactcgcctgggggcggcctgcgctccctcgtcggcacgccggcctcctccgcgctgcactccttcgagccccaccctatcgtcggcgacgcctgggaggcgctccgccgctccctcgtcttctttcgcggccagccccttggcaccgttgccgccgtcgaccacgcgtccgaggaagtcctcaactacgaccaagtgtttgtgagggatttcgtgccgagtgcactggcgtttctgatgaatggcgagccagatattgtcaagaacttccttctcaagaccctgctgctgcagggctgggagaagaaagtcgaccggttcaagcttggggagggagccatgccggctagcttcaaggtgatgcatgacgccaagaagggggtcgagaccctacatgctgattttggagagagcgccattgggagggttgcacctgtggattctgggttctggtggattatactcctccgggcctacacaaaaagtactggcgatttgacgctggcagagacaccggagtgccagaaagggatgaggctcatactcagcctgtgcttatctgaggggtttgataccttcccgacattgttgtgtgctgatggttgctgtatgatagatcgcagaatgggtgtatatggctaccctattgagattcaagcccttttctttatggcactaaggtgtgctcttcaaatgcttaagcatgataatgaagggaaggaatttgtagagaagattgctacccgccttcacgctttaagttatcacatgcgaagttatttttggctcgatttccaacagctaaatgacatttatcgttacaagacagaagaatattcccacacagctgtcaacaaattcaatgttattcccgattcaattccggactggttatttgactttatgccttgtcagggtggttttttcgttggtaatgttagtcctgccaggatggacttccgatggtttgcacttggaaacatgatcgctatactttcttctctcgcaacacctgagcaatctaacgctataatggatcttattgaggagcgctgggaagagcttatcggtgaaatgcctctgaagatatgttatcctgctattgagaaccatgaatggcgaattgtgactggctgtgatccaaaaaatactagatggagttatcacaatggaggatcgtggccagtgcttctgtggctgctgactgcagcctgcatcaaaactggacggccgcagattgcaagaagagcaatcgacctagcagagaggaggctgttgaaggatggctggccggagtactatgatgggaagcttggtcggtatgttggcaagcaggcgaggaaattccagacttggtccatcacggggtatttggtcgccaagatgctgttggaagatccttcacatcttggcatgatcgccctggaagaggacaaggcgatgttgaagcctgttttgaagcggtccgcgtcatggacaaattgagatggtgacgaaaatttttagggaggcgaagtcagctgaaaacacgaattcctgtggtagcgtctccttgtctgctgaccccttcatttgacttccaaaccaggatggtttgtgtctactt

SEQ ID NO: 3619 - DNA, 887 bp, Zea mays
tctatcaaatcagccacctgtcctctttttcttcaaatcaagtccgtttccctttcctttctaccctctccctcgtctccggcgggcggtggcctcacctccctctccccgtcgccctgatggctccctccacagctctcgctccggtggccttccgctccgccttctcgacgccgctcgcgtcgaaacctacccgtaatagaatgaacatagagggcgctttctgtttgccgtgttccacaaggaagagagcaagttatagacctttccgagtgtacagtttatttggagggaagaaggataaagatgagaatggtgatgaggcgccatcgaaagcaggaatttttggaaatatgcaaaatctctatgaaactgttaagaaggcccaaatggttgtccaagttgaggctgtccgggtgcaaaaggagcttgcagcgactgagattgatggttattgtgaaggcgaactaatcaaggttacactttctggaaaccagcaacctattagagttgaaatcacagaagctgcgatggagttgggtgctgaaaaactttccgggttggtcaacgatgcttacaaggatgcacaccaacggagcgtccaggccatgaaagagaggatggctgacttggcgcagagcctgggaatgcctgcgggcctcggcgatggtctcaagtgatgccgcaattcgggaaagctttccaataatcctttttcctcaattttgtatgctagccgtgtgagtagtaagcataacccctccgcgacctctcataagaagtgtacttgtgagcacttgttttctttcagctttagctgccatttgctgttctgcgcacgcagatatttgcacattaacttcacgtctggtctacaaagttgctag

SEQ ID NO: 3620 - DNA, 1464 bp, Zea mays
aaaggatccctactaccagacagagaggacaggggaggtcagactcagaaacgctcgctcacgacggcagcagccatggcagcatcgtgcggcggccgcgtggtggtcttcccgttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcggggggccgcgtccgctgcgtcctcaccgacgtcagctgggacgccgtgctgtcggcggcccgcggcctcggcgtgcccgcgctcggcgtcatgacggccagcgccgccacgttccgcgtctacatggcgtaccgcaccttggtcgacaagggatacctgccggtgagagaggagcgcaaggacgacgcggtcgccgagctacccccgtaccgcgtgaaggacctgctgcggcacgagacgtgcgacctggaggagttcgcggacctgctgggccgcgtggtcgcggcggcgcggctgtcctcggggctcatcttccacacgttccccttcatcgaggccggcacgctgggcgagatccgggacgacatgtcggtgccggtgtacgccgtggcgccgctcaacaagctggtgccggcggccacggccagcctgcacggcgaggtgcaggcggaccggggctgcctgcgctggctggacgcgcaacgggcgcgctccgtgctgtacgtgagcttcgggagcatggcggccatggacccgcacgagttcgtggagctggcgtgggggctggccgacgccggccgccccttcgtgtgggtggtccggcccaacctcatccgcggcttcgagtcgggcgcgctgcccgacggcgtggaggaccgggtgcgcggccgcggcgtcgtcgtcagctgggcgccgcaggaggaggtgctcgcgcacccggccgtgggcggcttcttcacccactgcggctggaactccaccgtggaggccgtgtcggagggcgtgcccatgatctgccacccgcgccacggggaccagtacggcaacgcgaggtacgtgtgccacgtctggaaggtgggcacggaggtcgccggggaccagctggagagaggggagatcaaggccgccatcgacaggctcatgggcggcagcgaggaaggggagggcatcaggaagaggatgaacgagctcaagatcgctgcggacaagggcatcgatgaatctgctgggtcggatttaactaatttggttcatctcataaactcctactgactcgagaca

SEQ ID NO: 3621 - DNA, 1845 bp, Zea mays
aattctagcaaggcagctcagcagcttttgtagcgagcttcttggagccttgaaatgagtagtagtggtagcctagccaccacgagtagcaagtaggcactataggcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcgccgccatcgacgacggtctcccgctctttgaagcggacgccacccaggacatccccgcgctctgccactccaccttgaccacctgcctgccccggtttaaggatctcatcgccaggattaacgccgaggctgaggccgagggacaacccaccgtgacatgcgtcgtcggcgacagcaccatgaccttcgcgctccgcgccgcgcgagagctcggcctccgctgcgctacactctggaccgccagcgcctgcggcttcatcggctacttccactaccgccacctcgtcgagcgtggtatggtccccctcaagaacgaggagcagctcacggacgggtacctagacaccatcgtcgactggatcccgggcgcgcccaaggacctgcggctccgggacttcccgagcttcgtgcgcaccacggatccgaacgacgtcatgctcaacttcttcatccacgagacggagggcatgtcgcaggcgtcggcggtggtcatcaacaccttcgacgagctcgacgcgacgctgctcgctgccatggcgaagctcctgccgcccatctacaccgtgggcccgctccagctgacggtgcggaacaacgtgcaggcgaacagtcctgtcgctgctattgggtccaacctgtggaaggagcaggaggcgccgctccggtggctcaacggccgtgcgccgcgctccgttgtgtatgtcaacttcgggagcatcacggtgatgtccaacgagcagctggtcgagttcgcgtgggggctggccaacaccggctactacttcctatggaacgtacgcccggacctcgtcaagagtggcgactccgccgggctgccgccagagttctcagctgcgacagagggacgaagcatgctgtctacgtggtgcccgcaggcagctgtgctggagcatgatgccgtgggggtgttcctgacgcactccgggtggaactccacgctggagagtatttgcggcggcgttcccatgctgtgctggcccttcttcgccgagcagcagaccaactgccgatacaagtgcaccgagtggggcatcggaaaagagatcggtgacgatgtacagcggggcgaggtagagtcgctcatacgggaggccatggagggggagaaagggcaagagatgctccggcgcgtgactgaactcagggacagcgccgtggccgctgcagggcctgacggacggtctatgcgcaacgtagacaggctcatcgaagaggtgctcctagcctagattgagcactggtgagcatcctagcagtcatgtgtcttcgcgtctggcactccaatcgattcaaatcctttgtgttttgatgtcaagcgtttactttcggtacccataaaagtattttctcgtacaaggtggtgattacacgcaaagcacattgttataagttcagtttgtaagatctatgggtaaaaccaagcgttttgtataattaaggaccgtttgagagggctacgactccttta

SEQ ID NO: 3622 - DNA, 2140 bp, Zea mays
actcttccaaccgctcctccgccattagcgtgcagatctaacgatcgctccgatcccaagcacaacaacttctccaattccaatcaccagccgatcagatttatgcagtcttactgccgcgagcgccagtcatgccgcgcggcagcagcttggaccagagcttgagcgacgacgagggctcggcaggtgttggggcggtttgggttcggcgtcgctggcaatgtccgggatgtccgactccgctgggggtgtgcgcgcgggcgcggagctgatggtgcagcagttccacctcaaggtgctccacgccgtcctcgccgtgcgcacgccgcgcccgcacgccttcgcggcgccagcggcggcgtcgttcaggcggagggacaggtggtttcatctcccgctccacgacccgccgccgccgcccgaggcggctgaccgcctggacgacctggtccccggggagccgatggtggtggacgtcctcctgagccccgccggtagtgtgggagcccgaggggaggtggtggaaaggtggactgtggcgtgcgagccctggccggacgccgcgggcggcgaggaggttgccgtgaaccgggcgtacaagcactgcttcacgctgctcaggtccgtctacgccgtgctccgcgtcctcccggcgtaccgcatcttccgcctcctctgcgccaatccctcctacaactacgagatgggccaccgcgtcgacaccttcgccgagcccttctcgcgcccccaggaggccgccatgcgttcccaacgctttgttcccgtcgaaacccagctcggccgcctcgtcgtttccgtccagtaccttcccagcctcgccgccttcaacctcgagatcacctccctttcgccctccaagataatcccagactacgtcggcagcccagccgctgagcccatgcgcgccttcccggcctcgcttacagaagccacgggctccggcttcccaccatctaatcagcaacagcgcccacacagctgggcttcgcctgtgttctggtcgcacacgccggcacaccaggccaggttctcgccgcctccagtgttttacgcgtcaccgacgccatcgcctccccactttccaccccgcctcatgaggtgggagtctgcaccaatgcccataccacaggtgagcgagaggaagagccctgcacaccgccagaatatgctaccaccaccttcgacgagaagaggagacatgagggcagcaggtgctctagagtctccatctgagagtggccggttgattgggaggatggaggaacttcgaatagctgatccatatgtgacctcgtcacccagacataagggcaaggacactaaagatggatctggcagattctctgcactctcctcatgcgattcaccacggcaagatgatctggatgatgtggattaccatttcgacgttgatgatgttgatactccagtctctcaacctcggagaatcgatgggaaggaaacaggtgatcaggttggttcatcatcccataaatctcaagacgcacaagtaggttctctagtcaacctgctgagaaatgccagcccgctgcgaaatcctagcaattcatcacagacatcaagggccgagtccagcgaagtagcctcagcaagctcggtcacgtcccgcaggacatctgacgcccttgaggagctccagtccttcaaggagataagggagcgactgctgttccggagcagcgcaaaacatcaagagccaccaggaaaaccataaggccattctttgctttgtttctcttaacgtgatcgctgatagactcccaaccgggaaaccatatgcacagcgaactatagttgctgtgttcatgtatatacgagtgctaaagttgatgcttttgattgaagagaaggcaccggcttccatttatttcagcggaacaatcactcgtcgttctcaagagtgatgccgctgttgatactcttttgtatatgggaagcgaaaccgatacacgtaggtgggagcgagggagcctgtgaattgtgatggatgaaagcaggtctcattgtgtgcgtgtgtttgtaaattatgtaactgctggaaatcaaatgttcattagacgtcaacctttgaagagttgctcgcacttcgcaagactag

SEQ ID NO: 3623 - DNA, 850 bp, Zea mays
tgcggctgagtacagacgacagaggaattggggatttacattagcgatttacaaggcaacttggaagacaagcagggtttcatcccgcaatgtcagctcccaacagcgatagcaacatgcagcagctagtccctatagcaccaccaggaaaggcttctggtggtgacagtgagaaggggctggttgtggtggatcttgcaggtaagagatcaggaggtgtaaaactacgagaggatgaggaagacctggaggtgaagctcaggcgcatcatggagaatgtccctgtgcgtgtcagtaacacatcagggtcctctgctggctctggctctggtgatttccaccagtatcggcaaatgaggaggagagagcaggaccggctagctcgaatggatgctgactaccagaagagaaagaagatggctgagttcgaactgcggagggaggagaggatgaaagcagctgaggagcggacagccaagaagcgcctgaaacggcaaaagaagaagcagcgtaagaaagagaagagagctaaaacgggtaataacggtggtgatgaacctaacagagtggagtcttctgatgacgatcacggttcggatgacgatgatgagtccaagcaatgacacgtcagttgcatctgaagatgatttcggacactggttgtctgggcattgaactaacgtctgtatggccgttgtaacaggttacaggccgaatctggtgctctatctgtaagaggacgtgatattttgagcagagaatgatagcactagataatttcatgttagtgttcatcattaaggtcttattcgtttacacaaattcagctctacattagcatggattgatg

SEQ ID NO: 3624 - DNA, 1271 bp, Zea mays
ctgatacccatccatccaccaacaactccccgctccggtgtccggtcgccgtcgcgactcacgcaacctcctcggctcgctagccgctacgctactatctacgtcgccacgacatctcccataagatggtagccgcagccgcagccgcagctgcagccacagccacagccacagccacagccgccgcgctcctcgcccccggtctaaagctctgcgcgggccgcgcgcgcgtctcctctccctccggcctcccactccgtcgcgtcactgccatggcctccgcccccaactcctccttccgcccagaggaggcgcgctcccctcccgccctcgagctcccgatcccgccgctctccaagttcaaggtggcgctgtgccagctctcggtgacggcggacaagagtcgcaacatcgcgcacgcgcgagcggccatcgagaaggcagcctccgacggcgccaagctcgtggttctccccgagatatggaatggcccgtactcaaatgacagctttccagagtacgccgaggacattgaagctggcggagatgcagccccttcattttcaatgctgtcagaggttgctcgcagtttacaaatcactcttgttggtgggtccatagctgaacgttctggcaacaacttatacaatacgtgctgtgtctttggttcagatggccagctgaagggtaaacatagaaagatccatcttttcgacattgacattccaggaaagatcactttcaaggaatcaaagactcttactgccgggcagagccctactgttgtagacacagatgttgggcgcattggtattggtatatgctatgacatccgtttccaggaactagcaatgctgtatgctgcaagaggtgctcatttgttgtgctatcctggtgcattcaacatgactactggaccactgcattgggagttgctgcaaagggcgagggctgcagacaatcagctgtttgttgcaacatgcgctccagctcgagataccagtgcaggctatgttgcttggggacactccactcttgttggacctttcggagaggtgattgctacaacggagcatgaggaggcgaccataatagcagatattgactactcactgattgagcagaggaggcaatttcttcctctgcaacaccagcggcgtggcgatctctatcagctggtagatgtccagagactgggttctcagtagcgagcctggatgcggctgtgtgcccgctctgcaggcttgctcgtactacttcggctctgctag

SEQ ID NO: 3625 - DNA, 2635 bp, Zea mays
cagctcatcagaacacagaaggcaggccacagcccgcaggtaggtagtccaccgaaacaaaacaccaccccgtctctcctcttcccagcggtttcctgatccccccacctcgttcgccgaggccgcagcgagcccgcccgtcctccgtccccgcgggagattgtgcgaccgcagagtttggatgctcctgcctatgcaagcaagatgtcaaccaccagagatattgtttagtgctgggcaagttatgcaattttggatcataaattacacagggacaagataattatggaccgcgcagacacatcaggctttgtcagtggtggttgctttggtactacactcctgctgatattcttccattttgtctattctacgatccatgtctgaaagaccctcaggaaccctgcagctgtctgggcagaaatatcatcaggcccctgttctttgagatctctggtgttttatctcattttgttttccaccattgttatattgtctcaactgtgatggataacggcttcatggacatccctcatccgcctctggtgaatgacccctttgtgttagtgggatgcccagcgccagcctccacgatggagaacatgggccaaagcacaatctgtatggatggcctgaacccagcaatggttagttgcagccatgttaatggaaacacacatataatgaacggcttaacagcaagagatgatggcagcaggttactccttggtttgggcccaacaccgaatttttattctgcagtgtccacgggctcaaaacaagctcagagattgtctggccagagttcaacttccattgattcagggatgctgaagcttggccttcagacggatgacagggaagcaattcaatatctgcaacaagcaccgaatggagcactccattctttagatattgttgacgaggcttcaacatctgctgctgtaaggaacatgggtggttacatgccatccctactctttgctccctgctccaattctattgccaatgagacacaagtagaaaaccaagattctctagacctcacgcacagcaccagcaacagtcagcaccttcaacatgacctccagctcagccccgaaccttctgcaacgaccgagtcatcatttggtatgagttctgatgttgtcactgcaacaactacatcagagcgtagccattcccgacatcctaagaaatgcaggtttaagggatgttccaaaggtgcaagaggagcatcaggattgtgtattgctcacggaggtgggcagagatgtcataaacctggatgccataaaggtgccgagagcagctccgcgtactgcaaagcccacggtggcggtcgtcggtgtgaggagcttggttgtaccaaaagcgcggaaggaaaaacagattattgcatcgctcatggtggaggctgccgctgccaacatcctggctgtcctaaagctgcccggggtaagtctgggcggtgcatcaagcacggtggtgggaagaggtgctcggttaaaggttgcatcaggagcgctgaggggaaggctgggctgtgcatttctcatggcggcggccgacggtgccagtatcctgattgcggcaagggggctcagggcagcacattgtactgcaaggggcatggtggcggcaagaggtgcatctttgatggttgcagcaaaggcgcagagggtagcacacctctgtgcaaagcacacggtggtgggaaacgatgcatgtttgaaggaggcggcgtctgtgcaaaaagcgtgcacggggctactgaatactgcgtggtgcatggaggagggaagcgctgttccgtgcccggctgcaccaaaagtgcccgtggccgcactgactgctgtgtgaagcacggtggcggcaagcggtgcaaggttgacagctgtggcaagagcgcccaggggagcacgcacttctgcaaagcccatggcggagggaagcggtgcacatggagcacaggctgcgaaaagttctcccgtggcaagagtggcttctgtgcagcacatggtaccttgatggccaggcagcgagaagaagaggtggtgaagaatgtagggagcatgattggaccaggtctcttcagcggcattgtggcgtcatctgccaccgcagcaagcagcatgacgaacgagcactcggcctctggtgtcagcaccgcttccgactgtgacggcacggtgaggagccaatcaatgattcctccgctggtgctggttcctcgctctatgatgccttcatggtcgactgagcctgtagatggaggcagagagggaggtcatgttgttcctgaggggagggtccatggtggtggcctactgtcacttctcggtggcagcttcagggacgccgacgtggaaaagctttgaagattttgtcagtttgtttgtacataaacaggccgcgttcccgcctatagaattgttattgtgccttttcttgtctagataaacatttcaaccttcatgtaccggttaaatcaatactggtttagtccattgtaaagtggtgactgtcaattgtcgtgaacacttttagcttgttggttcggttcggttgtagtctgtctgtttgtgcgtattcttaagaaactcgtctggactttctattgcaaattgtcgaa

SEQ ID NO: 3626 - DNA, 1661 bp, Zea mays
ttccctcccaccgaaatggccggcgatccctgcacccgcgccgccggtgaccgccccaccgccaccacctcctccgtcgccttcttctccgcctggggcgggctcggcctcggcccctccagcttgctgctccacctgctcctcctccactccctcttatagcctccagcctcccctcgcccccgccaccccccatggccgccgttttcttccaccacgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccggacgacccgccctcgggggccaggttcatcggcatgatctccgcgctcgacatcgccgccttcgtcgcctccgcgggggtcggggatcgctccatgcgcgccgtcgtcggcgaggtcgtgcagcccaatcctgcgctgctcagggagatcgatccgggtaccaggttgatcgatgctctggaactgatgaggcatggagtgaagcgctttcttgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattcagaagatccctcaagacccatgcgccgttgctgtagtggagacgatgccagatggaactcgtaacatactaggagacatctctacttacaagctgtggaaatgtgactatgtttcagctgcatgggcactggcaaacctgtcagctgggcagtttgtcatcggtgccgacgagaatgggtcaacacccatctcagtcttcccagagcctcccatcagcccatcgtcaccggtggaggagatcagtcctgggcgctcaccaagggcgaagaagttcagcagcaggagcatcgggtttctgaacaacacccagatgtcagcgtggcggacacggagcatgtaccaccggggcaggagcaccccactgatgtgcaagaccacaagcaccctcgcggcggtcatggcgcagatgctgtcccatcgggccacacacgtctgggtgacggacgcagagtcggaggaggacggcgtcgtcgtcggcgtggtgggctacaccgagatcttcaatgccgccaccaggagcacctgcccaagtccgacagcatcttgatgcaccacatcgtgctgtacagtatactgctgttggttgatccgttggtgccccggtgcacgctgttgcactgaactgtacaatgtactttgctcatttgttggtttgtctggagagtttttagtcttttagatattcttggtctgcatggagcaggacttggtggtatattgttgcattcgttgtggacggtacgaataagaattcgggcttgcctcggagtctagtccattttgcatgctc

SEQ ID NO: 3627 - DNA, 926 bp, Zea mays
cgaccgatccaagtagtgagcattagtggatctactacgtacatatatagaaggaaacagctgcagctctctctctcgctgtttcctgcgtgatctgcttgtgtagctactagctagctagcggagcggaaccacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcggagcgggcgctgggagcagcagcccgagctcgtcgtcgttctcgacggtgacgcaccacccggccgcggcgctgcaggtggggcagttcggggtggagccggaggaggccgccgacctcgcctacatgaccgagtacgcctacaacagctacatgaacatgatggacctcgcgcccggctacttcggcggagtcgtctacgactacgaccacttcaactgatccacgagcatgcaggaggaggaggagggaagctacaagacgaaggaaggattgactggcctatcagct

SEQ ID NO: 3628 - DNA, 1500 bp, Zea mays
tagcagtctcgatggccgccgccgactcctccccgctccacatcgtcattttcccttggctcgcgttcggccacttgatccccggcctcgagttcgccgagcgcctcgcagagcacggccagcgcgtgtctttcgtctccacccagggcatcctccgcaggctccgcccggtcgcgcccgcgttggcctcgctcatcgacttggtggccctcccgttcccgcgcattgacggcctccccgatggcgccgaggccactagcgacctcccgcccggcacggccgagctccacgtgcaggccatggaccgcctcgccccggccttctccgccttcctcggtgccgcctgcgccgacgggagcgaccgtaaggtggactgggtgctcctcgacaacttccacgcgtccatggcggacgtcgccagcgagcacaaggttccctgcatactgaacatgccctactccgcggcgacgacagaggatttcggcattccagacgcgtcggttctaccaatgttccggccatttgtcgagaccttcaagagatgcaaagtcatcgctgctcgtagcagcttcgagttggaaccggagtccctgcctctcatgacaaagatcctcgggaagccggtcatccccgtgggcctacttcctccggcgcccgccggaggcaacacgcagcgcgacgacagcgcagccctgtcgtggctcgacgagcagccgtccaagtccgtggtctacgtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttggtgacaacatcgccacagcgatacgggctgtcatgtgcgaagaagagagcaagaggatctttgtggccaatgctaagaggatgcaggagattgtggcagacgacgagtgccacaagaggtacatagacgaattcgttcagagcctgagaacctacaagaactgaaacatgcatgctgagtgcactcagcatacttggcaatggcattggcgttacacaagtgatccgctggactccagctaatagtacgatgtatcttattttgctgcaatatgtaactttatcattgtttggttgtaaaaatatttgaatttgtttctcgtgaattgcatgaaagttattcatatctatcattacaaaagctgactcg

SEQ ID NO: 3629 - DNA, 1538 bp, Zea mays
cgacttcaagcatcagactaccataatcatggctccgccgccggcaatgcagagcccaggagagctaaacgacggcgcctacgacgcgccgcacatcctattcatcccgagcgccggcataggacacctgacccccgtcttccgcgtcatcgccggcttctcgagccggggcatcgacgtctccgtcgtgaccgtgctgcccaccgtgtctgccgccgagactgactacttcaacggcctcttcgcagattaccccgccgtccgccgcgtcgacatgcacctattgccgctggacgcctccgaattcacgagagaggacccgttcttcctccggtgggaggccctgcgccgctccgtccacctcctccgccccatcatcaccgacgccgcgccgcgcatcacggccatcatcaccgacatcaccctgacctcctgcgtcatccccatcgccaaggagctggacgtcccgtgccacgttctcttccccacagccgccaccatgctctcgctcaacgcctactaccccgtctatctcgagaagctcaagggtggaccggagccaggcgtgatcggcgacgccgtcgacatccccggcgtgttccgcgtcccgcgctccgccctcccgccggcgctcctcgacgtgaacaagctcttcacgaagcagttcatcgacaacggcagagcgatcgtcaaagccgacggcgtcctcgtcaacacgttcgacgccgtggagccggcaccgctggcagccctgagaggcggcaagatcgtccccgggtacccgccggtgtacaccatcggcccactcaagtcgcacgccacgaaagcgggcgacaagccaggtgacgcgttgcttgacgaatggctaggtaagcagcgagcgcgatctgtggtgtacgtggcgttcggcaaccgcagcgctgccaggctggaccagatccgggagatcgccgccgggctggaggacagtggctatcctttcctgtgggtgctcaagaccacgaaggtggaccgggaggacgacgccgagctggcggaggtgcttggaaacggataccttgagcgcgtgaaagggcgtggcatcgtgaccaaggggtgggtggagcaggaggagctgctgaaacacccggctgtgggcatgttcgtgagccacggcgggtggaactcggcgctggaggcgtcgtccgccggcgtgccgctgctggtgtggccgcagctcggcgaccaccgcgttaacgcgatggcggcagtgagggcaggcatcggggcgtgggcggagcactggagctgggacggggaggacacgctggtgaccaggcaggagatcgccgacaaggtgaaggaggttatggccgatgagaagttgagggcgggcgtggcggtggcccgcgaggaggccgcaaaggccgtcgcggagggcggcacgagttaccgtaacatgcatgacttcatcgctaagctcaagggaggagcttgaggcttgaggagatgatgttacgttcattcccaccattccgacgagtgaagtgactgctgtt

SEQ ID NO: 3630 - DNA, 1827 bp, Zea mays
ggatccactgtccactgcgtctgtctctgtcccgagctcccgatccatccatctgcatcgtgggaacaagaagaacaatgggtatagtgcgagtcgcggacgatgtggaggccaggttggtggtcggggcaggtggcggcggcggggccgccaccaccacgacggagccgcttctccgccactgccacggcggccgcaaggaggaggacgaccaggggtctaagatccgggacagcccggaagcggagggggcgtccgactgcgggaggacggacggaggctcgctgcggatggtccttgtctccaccgccgtcgccgtctgcggctccttcgagttcggcacctgcgtcggctactctgcgccgacgcagtcagggattgtagaggaagtcgggctatctatctccgagtttgcaatttttggatctgtactgacaatcggagcaatggttggtgccgttactagtgggcgcttggctgattttctcggacgaaaaatgaccatgcggatatcagctactatttgtatcttcggttggctctccatacatctggccaagagcgctatcatgctctactttgggagaaccttactgggtttcagcactggagttctttcttatgtggtgcctgtgttcatagctgaaatagcgccaaagaatctccgcgggggtctcgcaacgtcaaaccagctcttgatctgttccggaagctcagctacctacatcataggagccctggttgcatggcgcaatttggtacttgttggtttagtgccttgtgtcctcctgctagctgggcttttcttcattccagagtcgccaagatggctggccaatgtcggaagggaaaaggaattccacgcctcattgcaaaagctgcgtggagagtatgctgacgtatcagaagaggcaattgagatcaaagagtatattgaatcactctatagccttccaaaggccaggattcgagacttatttctgagcaaaaatatatatgcagtcattgtgggcgttggcttgatggtctttcagcaactcggagggataaatggtgttggcttctatgcaagttatatcttcagttctgctggattttctggaaaacttggaaccatcttgattggcattattcagattccaatcacattgtttggggccatactcatggataggagtggaagaagggttctcctgatggtctctgcatctggaacatttttgggctgcttcctcacaggagtatcattctatctgaaggcacaaggactgttctcagaatgggttcccacactggctctttccggcatactggtttacatcggggcgtactcaattggaatgggccctgtcccttgggttgtcatgtccgagatattctcaatcaacatgaaagcaactggtgggagcttggtgacccttgttagctggctgggctccttcgcgatttcttactcgttcagcttccttatggactggagctctgcaggtaccttcttcatgttctcttcagccagcttgatcactgtactcttcgtggcgatgctggtccctgaaaccaaaggaaggacactagaggagatccaggactcactaaacaccagaagatagtaatgaatttacttcacactacagaataattaattccaagatggaaaaaatgggaatttacaggacacagcagaataattccaagatggaaaacgaatgtaccgtcagacctctgctcatcgatagatatgtatacaagaaacaaatatatataattctcacgtcctcccgcttcccctccctttctctcccgcgccacctccgtgtaatacgtagt

SEQ ID NO: 3631 - DNA, 1692 bp, Zea mays
acctgcctgccactatactatcagcctgtgcgagcgagaaatggacagagccgccaagcctcacttcgcgctcatcccattcacaggaaccatcagccacgtgatccccatggcagacctcggctgcctcctcgcggcccacggagccgaggtcaccatcatcactacgcccgtcaatgcagcgatagcacagagccgtgtcgaccgcgcacagtcacacggtgccacgactacgatcacggttaccgcagtcccgttcccggccgcggacgccggcctgcccgagggctgcgagaggatggacctgctccggtcccaggccgaggtgcctcgcttcttcgtggccaacaaaggcttcggtgaggcagtgtcgcggcactgcctcggcgaagcgctgcgccgtccgagctgcgtcgtctccggggcgtgccagacgtggacgctgggcctggcgcgccagcttgaagttccctgctacgtcttccacggtttcggcgccttcgctctgctctgcatcgagcacctgtacaggcacaggccgcaggaggctgccgcgttggctgacgacgagctgttcgacgtcccagcgctgccgccgcctttccggctcaggctgtcgcgtaggcagctcccgccgcatttcatgccgaccacttccgtcgccgggaaggcgctgcaggggatccgggatttcgacgtggccgcggacggcttcgtggtgcacaccttcgaggagctggagagcggctcgacggcgctactcgcggaggcgacgggcaaaaaggtgatcgccgttgggcccgtctcgctgtgctgcgcgccaagcctggatcctcggctcgtgtcgaacgatgatgcgaggcgatgcatggcgtggctggacgccaaggcgcccaagtccgtggtgtacgtgagcttcggcagtttcgggcgcatgccacccgctcagctcatgcagctcggcatggcgcttgtcgcatgccgctcacctgtgctctggctcgtcaagggcgccgactccctgcccgacgacgtcaaggattggctaagagagaataccgacgcagacggcgtcgcaggcagcaagtgtctggtggtgcgcgggtgggcgccccaggtggccatcctggcccatccggccattggcggcttcgtgacgcactgtggatggggctccatcatggaggctgttgcagccggtgtgcccatggcaacctggccctttttcgcagagcaatttatcaacgagcagctcatcgtgcacgtgcttggcgttggggtgtccgtcggtgtgacgaagccaacagaaaatgttttgaatgctactactgacgccgccggtggcagccaaggggaggctgatgccgaggtggggatggaacaggtgaagaaagccatggatacgctgatggatcaagggcctaaaggggaggagaggaggaggaaggcccatgagctgaaactgaaggcgaagagtgctttggagaagggaggatcatcctacactaatctggataatttgatcctgtcttttctttgaatgtcaccatgtcttacttttgcgtcccagcatacatgttttgtttgcctctgagtgtcatactatggagatttatttactctttatttattattactatggtcatttgtttctgtcgagtaaagttattgtattctagatcaaccggtgct

SEQ ID NO: 3632 - DNA, 1991 bp, Zea mays
caggcctcacgtgtcattccccaccgctcatatctccctctccgcctcggccgcttcccctccccgctccactcttccccgcgcgcctgtcccgttggccgcgaatggttctcgcgcgagtcctcccgctgcccgccccgtcgtccgcgccccaccgccgcttactcctgccgactcaggcgtcgccggccccggcgcgtgtgcccaccgtgcgggccgtcgcctgccgcgcagcgaacgccatggcggccgttgctctggacccgcccgcggtcgctccgagccccgcagaggtcgcagccgtgggcgtcggggaggagcttccggaggggtacgatcagatgatgccgaccgtggagccgtcgcggaggcggcgcgccgggctgctgctgcatccgacttcgttgcggggcccgcacggcatcggcgacctcggggacgaggcgctcgctttcctgcattggctccgcgacgccggctgcacgctctggcaggttctaccacttgttcctccaggtaggacggctggggaggatgggtctccttattctggacaggatgccaactgtggcaatacccttttgctatcccttgaggagcttgtaaaagatggtctactgatgtcagatgaacttcctgatcctgtggatacagagtatgttgaatttgacactgttgcaaatctgaaagaaccacttattgcaaaggcagcagagaggctcctactaagccatggagagctcagaacacaatatgactgcttcaaaaaaaatccaaatatatcaggttggcttgaagatgcagctctttttgctgctattgacaaaagcatcaatgcattctcttggtacgagtggcctgaacctctgaaaaatcgccatcttggagccttggaagatatatatgaaaaacagaaggattttatagagacatttatggctcagcagttcttatttcaaaggcaatggcagcggattcgtaaatatgcacaaaagctgggtatcagcatcatgggtgacatgcctatatatgttggctaccatagcgcagatgtttgggcgaacaggaaatcatttttgctggacaaaaacggtttccccactttcgttagtggcgttccacctgatgcatttagtgaaacgggtcaactatggaacagtccattgtacgactggaaagctatggaagcagatggtttttcatggtggataaagaggattaaacgtgcccttgatttgtatgatgaattccgtattgaccattttcgggggcttgcgggtttttgggcagtcccttctgatgcaaaagtagcactggttggaagctggagggctggaccaaggaatagcttttttgacacgctcttcaaagctgttggtagaatagatataatagcagaagatctgggggtaattactgaagatgtcgttcagctaaggaaatccattggggcccctgggatggcagttctccagtttgctttcggaggtggttctgacaaccctcatttgccacacaaccatgaaatagatcaagttgtgtacactggaacacatgataacgatacagttcttggctggtggcaaaatttaccagaggaagaaaagaaaattgtgatcaagtatctaccagaagccgagaatattgacatatcatggacactgatcacggctgccctctcttccgtcgcgaggacttccgtggtaaccatgcaggacattcttggccttgacagttctgctagaatgaatactccagctacccagaaaggaaactggaggtggaggataccgagctctgttggcttcgacagcctcagccctgaagcagcaaagctgaaggagctgcttgcgctgtacaatcggcagtgaagtccgctattgccatcgaagttccttcaataaaataggcaaccaaatgcgagcggtttggttgccaagttctatggtacgcggccccgcacagaggttgtgttctggttggctggaaac

SEQ ID NO: 3633 - DNA, 1544 bp, Zea mays
tcctcatgccgatcagcgccatgcgaccgtcgccatcttccgtagcgtcgtcgggggacacggcggcgccgcgcatgtacttcatcccgttcccgacgccagggcacgcgctgccgatgtcggacctcgcccgccttttcgcgtcccgcggcgccgacaccacgcttgtcctcacgcgcggcaacgccgccaggctcggtggccccgtcgcccgcgcggccgccactggcctccgcatccgtatcgtcgcgctcactctgcccgcagaggccgccgggctcgcgggtggccacgagagcgccgacgaccttcccaaccgcgagctcgctgggcctttcgcggtcgccgttgaccttctcgcgccgctctttgctgatctgctgcgccgccagcctgccgacgccatcgtgttcgacggtgtcctcccgtgggctgccactgcggccccggagctcggcatcccgcggtacgcgttcaccggcacggggtgcttcgcgctctcggtgcagcgtgctctgctgctccacagcccgcaaaatggcgtggcgtcggacaccgagccgttcctcgtgccgggcctccccgacgcggtgcggctcaccaggtcgaggctcgccgaggcgacgctcccgggcgcgcactcgcgcgagttcttgagccgcatgttcgacgccgagcgcgtcacggccgggtgggtcgtcaactcgttcgcggacctcgagcagaggtacatcgaacactacgagaaggacacggggaagccggtgttcgccgtcgggccggtctgccttgtcaacggcgacggcgacgacgccctggagcgcggccgcggcggggactccagtacggccgccgaggccgcgcgcgtgctgaggtggctgaacacgaaacccgcacggtcggtggtctacgtctgcttcggcagcctcaccaggttcccgcgtgagcaggtggcggagctcggcatgggcctcgccgactccggcgcgaacttcgtgtgggtcgtcggggacaaggacgcgccgcagctcccggacatcgacggcgcggcgcccggccgcgggctggtggtcagggggtgggccccgcaggtggcggtgctgcggcacgcggcggtgggcgcgttcgtgacgcactgcgggtggggcggggtgaccgaagcggcggcggcgggcgtcccggtgctggcgtggccggtgttcgcagagcagttctacaacgaggcgctggtggtggggctcgcgggcacgggcgtctccatgggcgcggagagggggtacgtgtggggaggcgaggcgctgggcggggtggtggtgggcagggcggcagtggcggagcgggtgcgcagcgccatggcggacgaggagctgcgggggagggctggacgggttggcgagcgcgcgcggcgcgcggtggaggcgggagggtcatcgtacgaggccgtgggcgcgctgctggaggatgtgctgcggcctcaacgccaggtccaggatctggatgccgtccgggagacgaggcgggatgctgagatttttaattaataa

SEQ ID NO: 3634 - DNA, 1636 bp, Zea mays
aaaggatccaactgcgcaagcactccacttcaagctcccaccatcaccggatcaccaccggtggcggactggcggtggggcacacaagacacaaaccgtcccttccgtcagcccgcacatctcacctgcgcacgcgccatgggaaaactgcaggagcgaaaaccgcctgcgtgcacaaccgccgcgcggccgcgcgtgctgctcctgtgcagcccgtgcatggggcacctcatccccttcgcggagctcgcgcggcgcctcgtggccgaccacggcctctccaccacgctcctcttcgcctcggctacatccccgccctcggagcagtacctcgcggtggccgccgccgtccccgacgccgtcgacctcgtcgcgctgccggcaccgccgccagacgcgctgcctcccgccacggccgcgcgcgagcgcgcggagctcgccgtcgcctccaacgtgccgcgcgtccgggagatcgcgcgggagctgggcgcggcggcgccgctcgtcgcgctcgtggtggacatggtcggcgcggcggcggcggcggcagcgcgtgacgtggcggcggagctgggcgtcccgttctacgccttcttcacgtccccgtggatgacgctttcgctgctcctgcatctccccgagatcgacgccacccgcgccggggagcaccgggacgccgcggagccgatccggctccccggctgcgtgccgatccacgcccacgagctgccgacgtccatgctcgccgaccggagcagcagcgcgtacgccgggttcttgtccatggccaagggcgtcgcgggagtcgatggcgtccttgtgaacacgttccgtgaactggagcccgcggtgggcggcgacggtggtctggagctgccggtgtacccggttgggccattggtttggaccaggccggccggcgtggacacggaccacgagtgcatgtgctggctggacgggcagccacgtggctccgtggcgtatgtgtcgttcggcagtggcggcacgcttacatggcagcagacggctgagctggcgctggggctggagcttagccagtgtaggttcatctgggctatcaagaggccacaccagagctcaacaatcgcggcgttcttcgggactcaaagaggcgatgagcacagccccttggactttttacctgaagggttcatggagaggactagaggggtggggttggtgacccagtcttgggcgccacaaacagctatacttggccacccttccattgggtgcttcgtcacgcattgcgggtggaattcggtcctagagagtgtgatcaacggtgttcctatggttgcttggccactctacgccgagcagaacatgaatgctgcgatgatggaggtccaggttggtgtggcattgcgggctaaggtcggagctgatcgatttataaggaaggacgaagttgcgaatgcgattcgacgtgcgattgtaggggaggaagctgaaaggctgaggaagcgatcaagcgagcttagacgccaatcagcgcaagctctgagcaaggatggttgttctactcgtgctctggcacaaattgcaaatgcatggaaacgcgctagcagaaaatgaagaaaactcgacgttatgtttgcagctcggtacctta

SEQ ID NO: 3635 - DNA, 1242 bp, Oryza sativa
aaaggatccaaattcccaatttcttcggtcgcgacgccgacgccgacgggaagcaaatcgatggacggcggcggcggcatgttgggcgccgtgttgtgcttgctgctggtcttcgccatcttccccctcctcctctggcgccgccgctccgatgccgcccaccgcctcccaccccagccgctccaggacgaacgtgtgctccgcggcggtcccgctcccggtccggcggcgcgccgcatgcgccggaggccgctctccacttcggctgacgcttccaccagccgcgaccgcgatgtcgacgacgctgacagtgacctagaggaggagatccaggatgtccccaggggttccaagaagaaggagaagaaaaggcaagaccgagaggcccagcgtcaggccgaagaagcagcccgggattcgaggaggactaaacaagatcgctatgcagaaatgaggaggaagaaagacgaagagcgtgaggcacaagagagacttatggaagaagaagcaagggcgaggaaagccaaagaggaggaagctgctgccttggaatttgagaaatggaaaggagccttctcagttgatgctgaaggtacaacagagagtgacacacaagatgatggccagggtttgctccacaattttgtagagtacatcaagaaccagaagtgtgttcctctagaggaccttgccgcagagttcaggatgagaacacaggactgtatcaaccggatcattacacttgaaggcatggataggctatctggtgtcatggatgatcgtgggaagttcatatacatatctactgaggagatgaaggctgtcgcagattacatcaggaaacaagggagggtgagcatatcacatttggccagtaactcaaatcaatttattgatttggagccaaagccccagtacaatgaggagagcaatctcgatgagaatgccgcagcaggcaccgagctttgaggagacacttgacctcatctcatcgccctagcataccctccctttatgtgatagattgggtggccgtatggcgatgacaaagtttgctaacctgagcgaggactaaggatttgtatgagagttggttctcacatggtaaatatcatgaaggatgagcaagtataaggttggaagaacagagtatgcactctgcttttgcagacttgtgcagcctattttactagtagtactagttcatagcgctcttaggaacctgtgtgtgctctcgagttt

SEQ ID NO: 3636 - DNA, 1538 bp, Oryza sativa
cgcccatggcctccgacgccaagcccgactccccgcccgccggcgtcgaccccccgccgcccaaggaggaggcgaaggcggagaaggagggggagggggaggagccgcagtcgggggggcggaagcgcgggcggcggaagaagggggaggcggagaaggagaaggagaagcccccgcccgccacccccaccatcgagaggccctccagggagaggaagaccgtcgagcgctactccgagctcgccccccgcgtcacccccgccaagaagtcccccgccattctccagggctctggatcgaagctgaaggacattcccaacattcaattcaaactatcaaaaagaaaggcagacgagaacctgcaaagtcttcatgttttaatgtatggaagaaaatcaaatgtccatttcttgaagagaaacatatcccaattttctggttttgtttggactgacaatcaggaaaaacaaaggaccaggataaaggaaaagcttgacaaatttaacaaggagaagttgctggatttttgtgaaatccttgatatacatgtttccagagcagccacaaagaaggaggaagtctctgccaaattactggaatttttggagtccccttgcatcactagagatgttgttctcactgatgataagaaagggaagaaacgtggaaggagatctaaaggaaatggccaggcgactgctgaaggcgcttctgatgggaagaaaaggagaaagagtcgaaagcaatcaactgaagctgctaaagagaatgacgatgaagacgatgagggtcctgctgattctgaggatgcatcaatgggtgaggaagatgatgaggattctgaagcaaaagataatgctgggagtgatgaagaacctgatgagcctccagcaaagaaaaaggcaacagatgataaacaaacaaaaaaggcaaaagaaaaggatgcgactgccaagaaggcttctacaagacctgcaaaaggtgtgtctaagccttctcaagacactgaagaagatgatgagccagaagttgagttagaaagcaaaaaggttgtcaaaaaagtctcaaagagttcaaaggagagtgatgttactgtagataaaaccaccaagaaggcttctaaatccaaaaaggatgaaggaaaagatggccagaacaataattctggtgcattgaacaataaggcacgcaagaaggatgctgccaagacaaccaataaaaataaaggaaaaggaaaaggcagcacagaggctggggcagccccaaccactgaagagctgcatgctgttgttagtgacatattgaaggaagttgacttcaatacggcgacattggcagatattcttcggcaattaggtactcattttaagatggacctcatggataggaaatcagaggtgaaacacattattgaggaagtaataaatagtatgtctgatgatgaggaaggtgaggaagacaatgctgaagatgacaaagacaaaaatgctaaggaggaaaattcaaaggaagatgctgatggtgacgagaagtaataa

SEQ ID NO: 3637 - DNA, 638 bp, Oryza sativa
cggtcatgggtggtggtgcggcggcgagcagggtgtcgtcggccatggccgtggcggtggcggcggcggcggcgttggtggtgatgtgggcggggacggcgacggcggcggcggccgtgtacgaggtgggcgacaagaccgggtggaccatcatgggcagccccaactacacagcctgggccgcctccaagaagttccatctcggcgacaccgtcgtcttcacgtacaacaagcagttccacaacgtgatggcggtgagcaagtcggactacaagaactgcgacacgagcaagccgatcgccacctggtcgacgggcaacgactcggtggtcctcaacgccacgggccaccactacttcctctgcggcttcccgggccactgcggcatcggccagaaggtggacatccgcgtcgccgcctccggccactcctctgctgccccttccatggcgcccgccccggcctccggctccgaggcacccgtcgcccccggcggcggcggcggcggctcgtccggccacgccgccgccgccgccccgtcgccgcacggcaacgccgccgttggccgctccgtcttcacggccatcgccgtgtccgtgctctccgtcgccgccgctggcctgaagttgatctagtag

SEQ ID NO: 3638 - DNA, 1370 bp, Oryza sativa
gactaccaatccaatctcctcctcgccgccatcgcgatctccgccgccgcccgcctgtcgcggccatggcgtccaccaagatcaaggtcgccaaccccattgtcgagatggacggtgatgagatgactcgagtattctggaaatctatcaaggacaagcttatcttcccgttcttggagttggacattaagtactttgatctcggacttccataccgtgatcaaaccgacgataaagtcacagtggaggcagcagaggctaccctcaagtacaatgtggccatcaagtgtgcaaccattacaccagatgaagcaagggttaaagagttcagcctaaaatccatgtggaagagcccaaacggcacaattagaaatatcctaaatggcactgtgttcagagaaccaataatctgcaaaaacatccctcggcttgttccaggatggactaagcccatttgcattagaaggcacgcatttggtgatcagtaccgtgcaacggatgcagttatcaagggacctggcaagcttaaattggtttatgagggaaaagatgaggagattgagctggaggtgttcaacttcactggtgctggaggagtggcacagtctatgtacaacactgacgagtccatccgttcctttgctgaggcctctatggccactgcttatgagaagaaatggccattgtacctcagcaccaaaaacacaattttgaagaaatatgatggcaggttcaaggacatcttccaggaggtatatgaagctcagtggaaatcaaaatttgaggctgctggaatatggtatgagcatcgtctcattgatgacatggttgcctatgcactcaagagtgaaggaggctatgtttgggcttgcaagaactatgatggagatgtgcagagtgatttcttagcacaaggttttggatcattgggtttgatgacatcagttttggtatgtcctgatgggaaaaccattgaagctgaagctgcccatgggactgtcacccgtcattaccgtgttcgtcagaaaggtggtgaaactagcacaaacagcattgcctcaatctttgcctggacaagaggacttgcacacagggcaaagctagatgacaatgctaggctactggacttcactcagaagcttgaagctgcctgcattggcgctgtcgagtctgggaagatgaccaaggaccttgctctgcttgttcacggatcttcaaatgtcacgaggagtcattacctgaacactgaagagttcatcgatgctgttgctgacgagctcagatcaaggctggcagccaactaaagctaatcaaatcaagtgattttgctgttattgatgtgaaccgatgcacttcgattatacatttct

SEQ ID NO: 3639 - DNA, 1826 bp, Oryza sativa
tagtggtggagagacgaaacacaggacgccgaaattctctcgcccacggattcccctccactcgcactgtcagtctgtcactctctccgccgccggccgccgaatctccggcgccgatggaggcagaccccaatccgatggtggtgctgcacgcctgcctcggcgtgggccacctcatccccatggttgaactcgcgaagctccttctccgccgcggcctcgccgtcgtcatcgccgtgccgaccccgccggcctccaccgccgacttcttctcctcgtccgcccccgcggtcgaccgcatggcggccgccaacccttccatctccttccaccacctcccgccgcccgagtaccccgacccggatcccgacgccttcctgcagatgctcgacacgatgcgtctcaccgtgccacccctcctcgccttcctccgctccctcccctcggtcgcggctctcgtgctcgacctgttctgcgtcgacgcactcgacgccgccacggcggccggcgtcccggcgtacttctactacacctcctccgccggcgacctcgccgcgttcctccacctcccgcaccacttcgccaccacggaaggcagcttgaaggacatgggtaagacgcccctccgctttcccggcgtccctccgatcccggcctccgacatgccgcacaccgtgctcgaccgcgcggaccggacctgcgctacgcggctggggcactacgggcggatcccggaggcgcggggtattctgattaactcctacgaatggctggaggcgaggtccgtgagggcgctcagggaaggcgcctgcatccccgaccgccccacgccgccggtgtactgcatcgggccgttgatggcgaaaggcgaggaggcggcgaacggggaacgccacgcatgcctctcgtggctggacgcacagccggagaggagcgtcgtgttcctctgcttcggcagcttgggcgccgtctcggtgaagcagctgaaggagatcgctcgtgggctcgagaattccggccaccgtttcctctgggtggtgcgtagcccgccgcaggatccggccaagttcttcctgccgcgtccggagcctgacctgggaatgctgctcccggaggggttcacggagaggacgcgggacaggggaatggtggtgacgtcgtgggcgccgcaggtggaggtgctccggcacgccgcgaccgccgcgttcgtgacgcactgcgggtggaactccgtcctggaggcggcgtcggccggagtgccgatgctgtgctggccgcagtacgccgagcagaggatgaacaaggtgctcttggtggatggcatgcagctcggagtggtgatggacggctacgatgaggagctggtcaaggccgaggaggtggagaagaaggtgaggttggtcatggagttcgaggaagggaaaaaactcagggatagactgacaatggcgaaggaaatggccgcgaaggcgctggcagacggcgggtcgtcgtcgttggcgttcaccgaatttctgaaggatttgaactttggaaacactacaaaggaaaaagcgtagaagacgaacattgagcagtgcaaacgatcaagcacaaaagatgaacattgagttggaatgatttatattgctgctggaatgtgacaaaatcacatatctgcattatttacccgctgtgaactgtgctatttttctgtatttctgatgtgagcagaaggtgtgagagtttcttcaggctgattagctgcttcagcagtcagcacttgtaggagctctttaagggcgaattccagcacactggcggccgttactagtggatccgagctc

SEQ ID NO: 3640 - DNA, 2544 bp, Oryza sativa
cttggtccgtctccactctctccactccgccgccgccaccgctcgtcgtcgcctccccccccaaatcaaaaatcaaaatcaaaacccccccatctcttcttctagtttcttctagaagccgggacgaacaccgcgtcgtcttcgccttcgccttcgtcgtctcccgctcgcttcctccctcctgggttaggctgtgcactgaagtactgaacgttcttttgtagactgttaagcttatcctgcatcatggagaatggagacaaggatgagaaaaatgttgctgtcacggaaggatctaccaattctgaagaaaaggatcaagatgaggatttgttgaggagaacagaaatgctgaatgcaaaagaagcaataaattcttcaaatgagaattcaggcaatgattcagaagcacagatccatgtgagagatgattcacaaaaagaattcaatgagaagatgaataaagaaggaagctcagatccaatggaacctacagattcaagccagacagaggaagatatccttgctgaagacaaatctgaagaacctgtttttgatggaactgaggttgctgaaatggaagatttgaggcgttcgtccaatcaatctgtggaacttgattcagatgcccatgggtctgtactcaatgaaagagctactgcaatcaagaattttgttaaggaaaagggtgccattgcagtttcaacatttataaggcgcctttctggcaaaaaggacgaaaatgaattttctgttgaagatgaaaagaatgaaggatcagaaagcatcagtagtggcaatattggctcagatgctgaacctaaatcaaaagaggtgcagcccaaatctgaggagagaactacatggaatccactcaacttgattaaaatcggacgagattttgataccttcatgactggggaagctgggcatgaaaatgtgccagatttgatagagcaaccaacagggaagggaagaattattatatacacaaaactgggttgtgaagattgcaaaatggttcgctcattcatgcgtcagaaaatgctcaagtatgttgagatcaacatcgacatattccccagtagaaagatggaactagaaaataatactgggtcatccacagtaccaaaagtgtatttcaatgacttgctgattggagggttaactgaattgaagaaaatggaggagtctggcattcttgatgacagaactgatgctcttttcaaagatgaaccctcatctgctgctccgttgcctcccttacctggagaagatgatgaatctggtagtgggaagatagatgagttggcaaccattgtcagaaaaatgagagagtcaatcactctgaaggatagattttacaaaatgagaagatttagcagctgctttcttggtagtgaagctgtagatttcttatcagaagatcaatatttagagagagatgaggcggtggaatttggaagaaagcttgcaagcaaatatttctatcgccatgttttagacgaagatgtatttgaagatggaaatcacttgtatcgcttcctggataatgatcccataattatgagccagtgctacaacatccctaagggtatcattgatgttgaaccgaaaccaattgttgaagtggcatcaaggttaagaaagttgtctgaaaccatgtttgaagcttatgtatctgaagatggtaaacatgttgactacagaagcatccagggttgtgaagaatttaaaaggtatgttagaacaactgaggagctccagagggtggaaacccatgagttatcacgggaagaaaagctcgctttcttcataaatctctacaatatgatggctatccatgcattagtgacatgtggtcatcctgctggaccattggacaggagaaagttctttggagattttaagtatgtcattggtggatgtgcttattcaatgtcagctattcaaaatggcatactgcgtggtaaccaaaggccaccatacaaccttgccaagccttttggacagaaagaccaaagatccaaggtggcccttccatatgctgaacctcttgttcactttgctttggtatgtgggaccaaatctggacctgcacttaggtgttactcgccaggaaacatcgataaagaactggtggaagctgcacgtgatttcctaagaaatggaggaattgttgttgatcctgaagccaaggttgcatctgtaagcaagattttgcgatggtatagcacagactttggtaagaacgagacggaagtgctgaagcatgcggcaaattatctggaaccagcagagtcggagcaattcttggaactacttgcgaacactcaactgaaagtcttgtatcaaccctatgactggagcttaaacatttagctgcagccatggtattcacatagatgtctagttatacttgaatacctgtcacagatactcgtggaagatcacgacttcttttacaccagaattttcccaagagttggtcacagctctggatgctgttttgttgtggcacaaagaaatgagtaccaatcctag

SEQ ID NO: 3641 - DNA, 800 bp, Oryza sativa
tactgtaagcagtttcccaccaattgggcctcgaaagtttccgtgtggcccatcgtccccggcgcggccgcggcccaactccttcgcgtggaggcggcgaccgcttcagcctcaaagtctcgaacccctccgccgccgccgcctggctgctcggccgctcctccgcttgctctcccttgcttccgagggctccgccgcacggggtcgtcgcggctagagggtgggctcgccgtcgaggaaggcgggggtgtctggctcatcgagaacagtgccgaggggaatccgggttgcgggggcgatggccatggccgcggcggaggcgcgggtgcggcaggagaaggtgaagaagttcgaggacttcgtcgaccggagactgaagccggaccttgtgaacaccatcgcgcagcgggacaaggtgttccagcagcagaagaccttcttggacttgaaaaggaacatcgaaaatttggagaagaatggagtcaccagtatgcgatccatggtcaatcttggctctgaggtgtacgcccaggcagaagtgccagatacaagacacatttttgtggatattggtctaggtttccatgtggaatttacttggcaggaagctttgcagtttatatctgtaagagaatcaaggttggcaagacagatagatgagtacactcatctcatcgcaagcataaaagcgcagatcaagttggtatgtgaaggtatccgcgaactactcgagctaccagcagagtaaaggtgaaagttggcaatgcaatcgtatgggggtgcttggtagaatgacttgt

SEQ ID NO: 3642 - DNA, 1718 bp, Oryza sativa
caaacggttgggaggttagcagccatggcaatggaggcggaggctctcctgccggagccggagccggagtcgccgccgctgctcgccgtcgaccacctcggcggcccggcctcccgcggcagctccggccggtggcccgccgcgttcttcctcatcggagcggaggtaggcgaaaggttcgcatactcgggcatcatggggaacctggtgatctacctgaccgggccgctccggcagccgacggcggcggcggcggcggcggtgaacgtgtggatgggcacctcgatgctgctgccgctgctcggctcggccgtcgccgactcatggctcggccgctaccgcaccatcgtctgcgcctccctcctctacatcttggggctgggcatgatcactgtctcgtcggttcttgcaccggaagagtcatccgagagctcaaatctagctgctcatgtggctttcttctacttctcactctacgtggtggcgtttgctcagggcggacacaagccttgcgcgcaggcgttgggtgcagaccagttcgacgagaacgaccccggcgagctcgcctccaggagctccttcttcaactggtggttcttcgcctcctacggcggcaacactgtcactgttcccatcttgaattatgtccaggaaagcgtaagctggcagcttggcttcgcaatcccatgcatcgccatggccgtttctcttgccatcttcttgatcgggacaaggagttatcgcttctaccctccgaagagtaagggaaacccattcggagaggtcgccgagtggattcgacgttggatcgcatcgtcctgttcgaaattgcctgacagttctgatgagttgctaccgtcatcatcgtctgagggggatgtcagcaattcaagcagtgaattcgtccctaatgaagctgcagagctggtcaagttgtttccaatatgggcttccagcctgatatatgctgctgtgatggcacagtgcatcactttctttacaaagcaagcaagcacactggacagaagggtaggcagcttagtgctgccagctgcttcaaacggggcattgttcaatgctacaatcatggtcttcctcccaatctatgacagaatctttatcccagtggccagaagatacaccaagaaccctagcggtatcaccacgctgcagaggatcggcgtcgggttggttctctcgatcatcacgatgatcgttgctgcaatggttgagatgaggaggctcaggatagcaagagatttcggccttgtggacaaacctgaagctgttgttcctatgagcttcttgtggattgttccgcagaacattctggctgcaatttctgatatgtttgctgtgattggattgcaagagttcttctacggtgaggcaccggagagtctgcgaagcttttccatggctctgttcttgagcataattggagttgggaacttcatcagtagtttcattgtatatgccattgacagggtgaccagtagctttggagacagctggttctctaacaatccaaacagagggcatgtcgattacttctacttgcttattaccgtgctcaatgctttgtccctggcctgtttcttatactttgctaaaatgtatgaacataggaaaaaggtcatctcagtgcagtgacattgtgtgcagcctacatatttgtagctccactgataaggtcaccttcacaatctgatccagtc

SEQ ID NO: 3643 - DNA, 1747 bp, Oryza sativa
acgactccgacgagcgacccctccgcgggcaccgggtcgccatgtaccgcgccgcctccggcctcggggccatcaagcggcatggactggatggtcaaatgttgaatgttgcgattaggtgtgctagcacaagtgttgcacagaggtcatcaggtggcttctggacctggctgacaggtgcacggtcaaatgcattacctcctccagattttacacttccaggggtcaccattccacctccgctacctgaccttgtggagcctggcaagacaaaaatcacaacacttgcaaatggtgtaaaaattgcttctgagacaactccaggaccatcttgttcagttggagtatatgttaattgtggttctgtacatgaagcacctgaaacactaggtgccactcagctgttgaagaagatggcctatacaaccactacaaacaggagccatttgcgtgttgtgcgtgaaatcgaggcagtaggtggcaatgtgaaagcatctgctaaccgtgagatgatgagctacagttatgcagccctgaaaacttacatgcctgaaatggttgaggtgcttattgattgtgtacgcaatcctgcttttcttgattgggaagtcaaggaacagataatgaaactgaaggcagagcttgcagaagcttcaagtaaccctgaaacttttcttttggaggctcttcattctactggttattctggtgctttggcaacccctctgattgcctcagaatcctcagttagccgattgaatacgaatgtcctagaatacttcttagctgagaattacactgctccccgaattgttctagctgcaacaggtgttgatcatgatgaattggtatctattgctgaaccacttctgtctgacatgcctggtgtaactggaccagcaaagccaaagtctacctatgttggtggggaatatagaagaactgctgattcatcgaacacagatgttgctttggcatttgaggtccctggtgggtggctcaaagaaaaagaatttgtaacagtatcagttcttcagacccttcttggtggcggtggcacatattcctggggaaggcatggaaaaggcttgcattcaagtctaaatcatctcgcaaatgaattcgaccagattagatcgatagctgctttcaaggatgttcacagtaacactggcatttttggaattcatacatctactgatgcagcattcgttcctaaggctattgacttggcaaccagagagctcacttctcttgccactcctggaaaagttgaccaaactcaacttgaccgtgctaaagcgacagctaaatcagcaatcttgatgaacctggaatcaaaggcatcagcaactgaagacatgggacggcaaatattggcctttggtgaaaggaaacctgttgagcaccttctcaaggctgttgatggtgttactctgaaagacattacagcccttgctgagaaaatcatatcatcaccattgacaatggcatctcatggaaacgttctgaacgtgccaacttatgattcagtcagtggcaagtttcgctcgaaatgagtagtaatgtggtcattgttttcctcctcctggacaagttttaactgttgatagtttttcctcaggccattcattggcagggtttcagagagaaaaataaggagcttcatacaattttgatcatttaactctggatgattgagaataccatattttacctttttctgcaacatttgtccacttgagtt

SEQ ID NO: 3644 - DNA, 1590 bp, Oryza sativa
agaagcgtagagcggtcaaggctgcgtcgtcgtcgtcgtcgtcgtcaccggcagcggaggaggaggaggaggagagaaggttcagaggaggaggaggtagcgaggcacgaagtagcagcatctcatctcatctctccctggctggctggggggaaattcgatggagagggacttcctgggcgcgatcgggaaggacgaggagcagcggaggcatgcggaggagaggaaggaatcagattactttggagcaggaggaggagcggcagcggcggcgatggattggtcgttcgcgagcagggccgcgttgatgtcgttcaggtcgtcgtcgtcggcggcggcggcggcggcgagggaggagacgagggagctcgcgttcccacacttctcggcgttagacggcgccaagatgcagcaggcctcgcacgtcctcgcaagacagaaatcgtttggtgccgagagccacggcatcccgcagtacgccgccgccgccgccgtgcacggcgctcaccgtggccagccaccgcatgttctgaatggggctagagtgattccggcctcgtcgccgttcaacccgaacaatccgatgttcagggttcagagctcgcccaacctcccgaatgccgtcggcgccggtggtggcgcgttcaagcagccgcctttcgccatgggcaatgcggttgccggatctacggtcggtgtgtacggaacaagggacatgccgaaggcgaaggcggcgcaattgaccatcttttatgctggttctgtaaatgtattcaacaacgtctcgccggagaaggctcaggaactcatgttcttagctagcagaggatctcttccaagtgcgccgactaccgttgctcgtatgccagaggcacatgtctttcccccagcaaaagtcactgtacctgaggtttcgcctacaaaaccgatgatgcttcagaaaccgcagcttgtttcgtctcccgtgccagccatttccaaacctatctccgttgtgtcacaagctacaagtcttccacggagtgcctcaagctctaatgtcgactccaacgtgacaaaatcttctggtccattggttgttcctcccacaagtttgcctcctccggcccagcctgagacactagccactaccactgctgcagctattatgccgagagctgtccctcaagcgcggaaggcatcccttgcccgattcttggagaagcgaaaggaaagagtgacgaccgtggcgccatacccattggccaagagcccgctagagagcagcgacacaatggggagtgccaatgacaacaagtcatcttgcacggacattgccctctcaagcaaccgcgacgaatcattgtcattaggccagccaaggaccatcagcttctgcgaggagtcccccagtacaaagctacaaatctgatctgggtgattgcccagtgtccatagattcggccattctgattgatgcaaaagacataaagaatcttgtgcattcaagcggggaggagggcttgggaagaggcataatatatagtatgttattgatggtgttcttgttcttgtttatgatgtgttttcacatggttaattcgcttaatg

SEQ ID NO: 3645 - DNA, 1523 bp, Oryza sativa
gctagctactagcaaattgaagccaagatgaagaagaccatggtgctctaccctggcctctctgtcagccacttcctcccgatgatgaagctcgccgacgagctcgtggagcacggatacgccgtcaccgtcgcactcatcgacgacccgctccaaaagcaaatcgccttcacggccaccgtcgaccgcgtcatctcgtccaagccctccatatgcttccacaggctaccacgcgtcgaccaccttcccgccgtcaccaccaacgacggcgaattctacctccccgggtatctggacctcgtgaggcgacacaacgagcccctccatggtttcctctcttcccatttccgcggaggcatacaggccctcgtcgtggatatgatgtccgtcgaagcgctcgacatagctgagaggctcaaggtccctggctacctcttccacccatcgaatgcaagcctttttgccttcttcctccagattccgtccatctgtgcagagagtaaacggagcttcagtgagctaggagacacccctctcgagatccctggcctccctcccatgccggcctcccacttcatcgacaatcggcccgaggagccgcctgagagtgaagtgtacaaggccgtgatggatttggttcgcaggtacactaataaatgctccaatggcttcctcgtgaacactgtcgactcgctggaggcacgggtggtgaacacgctcaggcacgcacgccgtcaaggcggccgggcgttgccgccgttctactgcgtcgggccgttggtcaacaaggccggcgaaaggggagagcgacccgagaggcacgagtgcctcgcatggctcgaccggcaaccggaccgcaccgtcgtgttcctctgctttggtagcaccggcattggcaaccactccacggagcagctcagggagatcgccgtcggcctggagaaatccggccaccgtttcctgtgggtggtgcgcgcccccgtcgtcagcgacgatcccgacaggccggacctcgacgcgctcctcccggcggggttcttggagcgaaccagtggccaaggcgccgtcgtcaagcaatgggcgccgcaggtggacgtgctccatcaccgggccaccggcgcgttcgtgacacactgtggatggaactcggtgttggaggggatcaccgcgggcgtgccaatgctgtgctggccgctccactcggagcagaagatgaacaaggttctcatggtggaggagatgggcatcgccgtggagatggtcgggtggcagcagggccttgtcacggccgaggaggtggaggccaaggtgaggctggtcatggagtccgaggcaggcgtcgagctcagggcgcgcgtcacggcgcacaaggaagccgcggccgtggcttggaccgacgttggctcgtcgcgcgctgcgttcacagagtttttatctaacgcagacagccgacagacatcgtgagttcgtggccgtatcgtgaactccggacatgggtggaggcataagtctaacgggtgacc

SEQ ID NO: 3646 - DNA, 1172 bp, Oryza sativa
accaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggttgaggaggaactggagcgtgccagggtaacaatctcagatagtgacgtggctgcatttctcccaagcaagcggaatgggaagttcctcaagacctttgttggccctgtaaatgtgcgggtggcgagaaaagaagataagctcagagtgaaggacgagtacaacaactacagggatagggctgcctatatgtttctattgttcccatccattctcctcctacttagatggtggatatgggatggatgccttccagccttggcagttcagatgtaccaggcttggctactattcctttacacaagttttgctctgcgggagaatttgttgattgtaaatggaagtgatattcgtccttggtggatataccaccactatttagcaatgctaatggctctcgttagccttacatgggagataaaaggacagcctgattgttccagcaagcagaggggggtacaacttttcctgcggtgggcaatcatgcaaggaattgcaatgcatctacagaataggtaccagcgtcaaagattgcgcacccggatagctctaggaaaggctaaaagaatggatgttgttgctggagaaacagctggtgtggaagggcagctcttgctactttacccggtccttttcacattacaggttttcgaaggatatgttggagtattacttcttaagacggctttgcacgggcttgcatcggaatggcaggttgtagtttgtgggatcttgctggtggtaatggcagtcggcaactttgtcaacacgatggagactttgatgttaaaattgaggttcaaagcaaaaatgaaaagagcaaagagcaggcaggatctcagtcgccaacaccaaaattgacaaagtgacccataatggtgactccatgcttggaaacagcgaatgctgacacaccatctctcttgt

SEQ ID NO: 3647 - DNA, 3544 bp, Oryza sativa
gggtgtcatcaaacggactacggagttgacactgtagactcctctcccccgcgtcgccccgatcatggcgtcgtcggcggagccgccgccgaagaagcggaggctcgtcgaggtccatgtcccgtccccggccccgagcccctcctcctcctccgctcccgcgccggcctcgccacggtccccggtcccgccccctccgggcgtgccgccgccgccgccgcctcccccacaaaccctagccgccgccgcctccccgcggccggaggaggccgtacgcaagcgccgcaacagggaggagctgcggggcctcttcgagtgctaccgccgcatccgcctctgcgtggagcgcaaggacgcgcgcctcctgcccgagctcgagcaggtgtacctctcgctcatcgccagctctcgaggttgtacaagcgttcaacgtattttagctgacttgattcctcaatatgcctcatactgccctactgcacttgaggcagctaccaaagtttccatcaacatgtataaatggaacctggccattgtaacaagaggggaagatgtggatggtgtggcataccagactgctagggcttgtattcttggcttaactgacatatgctccacagcatcctgtgaagcacccaaatcatctgttttaacaggaatctgctctgcagtttatattactgtcctcacattcttcatttcaacatttgatgggaaggatatctatcacataggctcaagaaaacttctaaatcttcaggaccctgtggagctgttagacattctaaagcaggattcagggggtgacaaccaacaggcagacgactgtttagttgaactgagagcactttcattgctatgcatatttcttttatttccagagaacatactagatgcctgttttgcgctgattgcttctgcagaagatgtaaacggagaaggattgtactttctaaagcagctaacctgccatctgaacagtggtatcataactgatgctctcgatgttcagggggatggagtctcccagtgtacaggaatggacgtagatcatcctagcaccaaagaatctgttgattccaatctatcttctcatagcgttggtgtttcaggaagttcaatgttgcagccaaatgagtgttacatgacaatggccatctctaggcatccatctttgaaaggctggatattattgaggtacaaaaagctgtgtgattcctgtagaactgatgtggtttcagaggtatcatcgtgtttaaatgttttgggctctttaacacaacttgaagacaataaaagtcacatgggcagtgaatcatcagtgctggacaagattgatgaaaattcaggggggtatttgcaacccaataaattggcatgttcatatgaacagagaatgcttttgaaaactgatatcgctgatagatatggagggaaaactgtgcagaataagaatgcacagatggtgcatactgatgaggtgaaaactgagaagttagcagatgtcaaactcgatgtctgcaagcaaggaaatgtaatttctgatgcagggcatcaagctgcaagacttgatatgcacacaccaaaatcaacacatgattctgctgggggagctgcaactctcacttctccggggcagaattttggaaaggcgaagcattcatattcagaaccatctgatctttatggtgctcatttctcgagggatgtgatttcagtttcaaaggaactttggattggttcactgggaaatagtgctgcagagtcactagttagatcgaaatttgaggagtttggccccttagcaaacttcttattttatcccccaaagaattttgccttggttgagtacgggaacataatgcatgctgttcatgcatatggatgtatgcagggttcctctgtttggggtggtggtctccaaataaggtatttagatagacttataggcagcaagggatttgctagtggtatagctgttggtgaaagtcgtcatatttatgttgctaaagtcaagaacaaaaaagataaagatgaggtgtttgatgaattaaaggccgcagggttgaagaggccatgtagctttacagatatttccagtgaaaatgctttgcttcttgaatttgatacagcaactgatgcagctgctgcgaaagcccatattaggcgccagcttcatccagatgtctgttcccaggacaagaatacttctggtcatgaactttttgtgcggaacatagacaattcagtccctgacatggagtttatcaatgcattttcacgatttggtgaggtcataaggtggcagttcaataagcttgatgggaactgcttgatagattatagatcacctaatgctgctgccactgcaaaatctcacctgcatggtgcaagatttgggctgaagtcaattagtgttgaatcaagatctgtgcatgataaaactttgtcgccttctgttccaatgctagccccgagtgtttctgacagcagtcaccatgagatcaggaatccaagggtttcagggtataatgcaggcttcacagtaccaacagagcgaccaatttatggtccatcggctcccagagctccacaaggcatcctcccatgcccacctgtttctgcacaccgtggtcctgtaataccaccgccacctattcaaacttcttttgtccgtcctgtatatcctggtccaggaagtccgtgggaaaatactaccccaaatccatccttcagtcacgcttctcctcgaatgatgcctggaagtagcttccgtatgaatccacctgctcctcttccttttataccatcttctgttacccctcttacacagtttcctggaggttcagcacagcagtctgagaaaaggccacctccacctccacctccaccaaatgtagcccccccaccatttactcgtcaagatataccacccccaccaccatctccaccaccactacctattactcagccaccttctgtgccaccacctccaaattcccctcctccgcttcaacctgctactgacccttctgactcacaaaagcaacgttctcatcctcgatggcagggctctctttcaaaaagtggtttacattactgttcaatctatgcaagtagaatagagttggatgcttgtagatatgaacatgcagtttctgaaccgacagggtggccttcaagattagatgtgacaaagcgaacggattaccaacatgtgaagacaactttctccaatactccacctagcaaaagagaggtctgtcggctattaccctgttcgaatggtgatcagaaagggttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtcgcgtagacacattccgtaacctcgtttag

SEQ ID NO: 3648 - DNA, 2168 bp, Oryza sativa
ggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacgttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatcaacttgtcggggcttggattaagcggcacgctaggttatcagctatcgagcttgaaatcagtaaccaaattcgatgtcagcaagaacaatttaaatggtgaaatcccataccagcttccaccaaatgtggttcagttaaatcttcgaggaaatgccttcagcggtggtgttccttattcgatatctcagatgactgatctggaaacgctaaatcttggtaagaatcaattgagcgggcagttgacagatatgttttctcagctgccaaagcttacaacaatggatttgtcattcaatagcttctcaggtaacctgcctccgagttttcaatacctcaagaacctcaaaacactagatgtggagagcaaccaattcagtggtcatataaatgtgctggccaaactttctcttgaggatctgaatgtgaagaacaacaagttcactgggtggatcccaagtaaactgaagagcattgacaatttagagactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtacctacatgaggtctgttcacctccagtgctccacaaaaacataaagtcttcaaatgtcttgcttgatgctgatctcaaccctcacctctcggattgcggcctttcattcttctatgaggacgcaagtgagaacttgggacctgggtacagtgctccagagtgctcaagaccatcagcttacgtgatgaagagcgatgtctacagcttcggagtcatcatgctggagctactaaccggccgaaagccttatgatagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctg

SEQ ID NO: 3649 - DNA, 642 bp, Oryza sativa
ctgtcctctactacgcatctctctctctcaggggaaaaaaaaatctcctctcggccgagatcgtctccaccgccggcgagccttcgaaaccggagctaaccagcgccaccgccgtcgctcgtcatgatacattttgtgctcctcatcagcagacaagggaaggtgaggctgaccaaatggtacaatccatatcctcagaaggaaagatccaaggttatcaaagaagtaagtacgctcgtcctgacaagaggtccaaagatgtgcaattttgtcgattggcacggatacagagttgtatacaaaaggtatgcaagcctttacttctgcatgtgcattgatgctgctgataatgaactggagactcttcaaatcatccatcattttgttgagatattggaccgatattttggcaatgtctgcgagcttgacctgatattcaacttccacaaggcatactttatattggatgaggttctgattgccggtgagcttcaagaatcgaacaagaaagcagtactacgcctgatcactacacaggacaacttggtggaagcagcaaaggaagaggcaagctcattgaggaacataattgcacaggccaccaagtagagcagcgcatcgtgcctgctacaatgatgatta

SEQ ID NO: 3650 - DNA, 1341 bp, Oryza sativa
taggaaggatggtactggctgtggcggcggcggcggcggcggcgccatgatgaggggcttagggccggctgcggcggcggcgctcggaggccgctcggcggcgaggtggtgcacgtaccggcgcgtcacagtcgccgtatgcctggggaacctcgtcgccgtgctgctcgtggtccgctcgctctactccgcccccggctacttcgcctccgcgcccagacgcgtggcggtgaagtattcggaggagcagattaggctggtcgaggagtccatccggattcgccgcgcagccgtgtccgtcgagctcgtggaagctgtgaaaaagctggagaaggtgttcgctagggaggagaagagacggaaggagttgccgctcgagctgaagcagaaggtttcctatgagattttagagaggatgcgtgatttgggggagaacagcaacacgaccgaacaacgagaagctttagagtcctggcgtttagagaagctgaaagacatcagaagtgcatctgctcagaatttgtcgatgtcagacctctctaatgaggaatcaaggatgttaaaacgagcattggagttaaattggcgaatgctaatggacgacattggcctttggatacctgttagtgtatggcatactgaacatgatgacaagcctgagaatgaaccagaagaagaagagataatagcaggtccacctttacccccagaatgcaatgctcaagtacataccgattacggtggtgctgctgttcgatggggcttaacacatcataaagaaagtgcagctgattgctgtcaagcttgtcttgatcaggctaaaagggccagaccaggggcattaaagtgcaatatatgggtttactgtccatcagagtatggatgctactcgccagataaatatgaacacaaacatcaagagtgctggttgaaacaggctgatcaccctaaattgaacttcaaagacaggtattctgagtcgtacagggatgctcatccatctgctcccgttgttgtgccatggatgtcaggtgtcatcactgtatgagctgcctacaggctatctagtatctactgcctgcaggagacaggaactccgttcggatgtgcaacgccacatcaaatttggtacagttccacgaactcatataccaattttcaaaattcttcttggcttttgtagtctttagattagtctagacggttagctagagttcatgtgagatagctggtgtattttttggatggacggttggtggcgaactctttttcgaagaagaaaaagtagaaaaagtagaaaaagagtacaaatgattcaagttgaaatcattgtgtttgcct

SEQ ID NO: 3651 - DNA, 969 bp, Oryza sativa
aaagtcgacaatctcccacgctccaaagcccgaaaccctagctcctgttcacatggcgccagggctccagcgcttcaccgacatcgccggggacggcgggccccgcctcgacgccgcctccggcgaggagctcctccgcatggaccgcgccgcctccgtcgccctcggccgccgcgcgccggagcccccgggtaccctgttcgtcaccaccaggagggtgatttggcttagcgagacggagaagggccaaggctatgcggtggacttcctcgccatcacgctccacgctgtgtcgcgcgacctggaggcgtacccctccccttgcatctacacgcagattgacgcagaagatggctctgatgaggaggctggtggatcagatttcgaagcaaatggtgatctgcagctaaccaaagtctctgagatgcgcattatactttcagaccctggtcaacttgatgcacttttcgatgtcttctgccattgtgctgaactgaaccctgatcctaatgctgtgcgcaatgaagagaatggctggtccggtggtgaaaatatggctgagggtgggtggattcatggtgatgaagacatgattgatggaaatgatcttgaagcccacatgttctttacgaacttgataggccaaaatggtgtacatgaccttggtcgttctgtacgtgagcttcaaattgatgaccagcgtttcgaggatgctgaggaagaagacgagatccaagaaaatggacattagaagcagaatgttcattttacttgttccgttccttgaggggactatgtcattggttcgtctgtagattaccactgatgctgcttggttcgcaatacttgcttcttctacttcctttccctctttcttgttctataggatcaacatctctagggagcatcgatggtaacttttgtgagaaaaaggtcttgctgctggtcaagaatgtaacttctagattt

SEQ ID NO: 3652 - DNA, 1272 bp, Oryza sativa
cttctagtagcacagtagtagcagccgccgccctcgacgcgcgtctgctcggggtgctcgcgggaggggagatcgaggcgagggagctcgggggatcgatcgacgggagaccgttggagcagcagagcgcaatgccgcgtgggaggcggtagggatggcggcggcggcggcggcggaggcgggagtatggcgaggggcgtagcgcgcgcggcgtcgttcggtggccgcgccgcgaccgcgaggtggtgctcgtaccggcgcatcacggtagccgtctgcctcgggaacctcgtcgccgcgctcctcgtgctccgctccctcacctccctcgcccccacaccgcccaaacgtcaggaagtggtggagtatacggaggagcagattaggaaggcggaggagtcgatccggattcgccgcgaggcggagcccgtcgagcttgtcgaggcggtgaagaatctgcggaagattttcaggcgggaggagaagaggcggaaggagttgccactggagttgaagcagaaggtctcgtatgagattgtgcagctcctgctcgatttgggggataacagcagtttcgctcagcaacgagaagcagtggaatcatggcgtttcgagaagttaaaagatataaaaagtgcatctattcagaactcaacaaagttagacctctccaacgaggaagcaagaaccttaaagcgagcactacagttcaactggcatgtgctgctggaagacattggtctttggataccatcagaagtctcacacactgaacatgatgacaaacctgagaatgaaccagaagaagaagagataatagctggtccacctttgccctcacaatgcaatgctgagctacatactgattacgatggtgctgctgttagatggggcttaacacaccccaaagaatctgctgccgattgctgtcaagcatgtctagaccaggctaagaatgccaggccaggtgaactaaggtgtaatatatgggtttattgcccatcagagtttggatgtttctctccagataaatatgagcataaacatcaggagtgctggttgaaacaggctgaccaccctaaactcaacttcaaagacaagtattccgagtcatacagagattctcatcccactgcccctgtcgttgtgccctggatgtcaggtgtcatcagcgcatgagctgttagtccccagaggctcatctgagattgggagatttgtaccgatgaaaaacttaaccaaagcaacttcatataccgattcttcctcgtt

SEQ ID NO: 3653 - DNA, 2419 bp, Oryza sativa
gagagattaattaagtggcaggctgccagcgatggtgatgttgtttccatcgccggcgacggcggcgctgctggtgctggtggtgctgctgctgcagctgcagctttggtcggcggaagcgcaggtggcggtgggctcagggccgccggcgggctgcccggacaggtgcggcaacgtgagcgtgccgttcccgtttggcatccgcaccggctgctccctcgagggattcggcctcacctgcaacaccacgagcaatcccccgcggctgatgatcggcaacagcaccctgcaagtcgtcagcatctcgctggccaactccacgctgcgcgccgtcgacatcgccggcgccgtgaacatcacgtacgacgtcgtcagcggaaccaccggcaacggcacgtggggcggcgtcgccgcgacctcaaccaacccgtacgtcgtctccggggaactcaaccagctcctcgtcacggcgtgcaacattcaggtaacccttgtcggcagcggcggcaacgtcatcaccggctgctcttccttctgctccatcaacgacaagtacacgggtggcgtgttcagaagccccggcaacaagtgcgcgggcatcagttgctgccagacgcccatctccatcggccgcccgtcctacagcgtgaaagtgacgatcatggataacgagtacagaggtgaggtgcccgaagcgatccgcatcgccgagctaggatggttcgacggcctcgccgccaacctgctcaagaagcctgcagcgaatgacacctcgctccggacgccggtcccggtggtgctggagtgggcggtggcatccaccggcctggatgtcacgctcgacgccgggctgaacaaccaggctgccaataactggtcctgccccacgcccggcgaggcaagaaggagcgcgtgcataagcaacaacagctactgccacaacgtcaccgacaactaccgaagcggttacgtctgccgttgtgacgacgggtacgacgggaacccgtacgtcgccggcggatgccaggacatcaacgaatgcgagcggccaaaggagcacggctgcttcggcgagtgcaccaacacgccgggagccttcttgtgcagatgcccgcacggtgcccgtggtaactacagcattccaaatggctgcaccaaatccaatctaggtttaactattggagttggaattggtagtggtgccggcctttttatcctggcacttggtgctgtctttttaacacgtaagattaaacaacggagagcaagaacactaagacagaagttcttcaaacagaaccgtggccatttgttgcaacaattggtatctcaaaaggccgacattgctgaaaggatgatcatccccttggcagaactagaaaaggccacaaataactttgacaattcgcgtgagcttggaggaggaggacatggcaccgtatacaaaggtattctctcagaccttcatgtcgtcgcaatcaagaaatcaaatgtgacagtccaaagggagattgatgagttcataaacgaggtagccattctatcacaaatcaaccaccgcaatgtggtgaaactttttggatgttgtcttgagaccgaagtgccattgttggtttatgaattcatatcaaatggtacgctttatcaccatcttcatgttgaaggaccaacatcattgccatgggaagataggctcagaattgctactgaaacagctagatcccttgcttaccttcactctgctgtgtcattccctataatccacagggatatcaagtcccataatatcctattggatggctcactaacgacaaaagtctcagactttggagcttcaaggtgtatcccagctgaacaaaatggggttacaactgctattcaaggaacactaggatacctagatcccatgtactactacacaggacgtctcacggagaagagtgatatttatagctttggagttgttttaatggagttgcttactaggaaaaaaccacactcatatagatcggctgaggatgagagccttgttgcacatttcactaccctacatgcacatggcaacttgggtgacatatttgatgcgcaggttatggaggaggggaaaaaggaagttaatgaagtagccgtattagctgtggcatgtgtcaagttaaaagcagaagagcgaccgactatgagacaggtggaaatgacactcgagagcattcgatcatcatcactgcagcaagaagtattgcatagtgttagcacaaagaaatctaaggagcttcatgtctcatggagccatgcaataagtgagggtacaagcttagattcaactaggcaatatagtctcgaagaagagaacttgttatcatcaaggtatcctcgatagcgattttttaatttttcttgtgtgagtttggatcgatattag

SEQ ID NO: 3654 - DNA, 1680 bp, Oryza sativa
tcgagaggtttcattcagtgccgaagctagctattccactccggtgcgtttgcgatgaagaagacggtggttctctaccccggcctcgccgtcggccacttcaaccccatgatggtgctcgccgacgtcttcctggaccacggctacgccgtcgccgtcgcgctcatcaacccgtcggtcaaggacgacgacgccgccttcaccgccgccgtcgcccgcgccgtctcctccaagagctcggccaccgtctccttccacatgctcccgcgcatcccggaccctccctcgctcgccttcgacgacgacaagttcttcaccaactacttcgacctcgtgcgccgctacgacgagcacctccacgacttcctctgctccgtgcagggcctccacgccgtggtcgtcgacgcgtcgtgcggtttcgccattcaagccgtgaggaagctcggggttccggcctacgagctctacccctgcgacgccggcgccctcgccgtgaacatccagatcccttcgcttcttgctgggttcaagaaactgggaggaggagaagaaggcagcgctcccctcgagttgttgggcgtgccacccatgtcggcttctcacgtgacggacttgttcgggcgctcgttgagcgagctgatcagcaaggatcccgaggccaccacggtggccgcgggagcgcgcgtcatggcggagttcgacggaatcctgattaacacgttcgtgtcgttggaggagcgtgcgctgcgagctctcgccgacccacgttgctgccccgacggcgtggtgctcccgccggtttacgccgtggggccactggttgacaaggccgccgccggcgccggtgacgagaccagccggcggcacgagtccctcgtgtggctcgacgggcagcccgaccgcagcatcgtgttcctctgcttcgggagcatcggcgggaaccacgcggagcaacagctgcgggagatcgccgccggcctggacaagtccggccaccgcttcctgtgggtggttcgtcgggcacccagcaccgaacacctcgacgcgctcctaccggaggggttcttggcaagaaccagcggccgcggcctcgtcgtcaacacctgggtgccccagccgagcgtcctccgccaccgcgccaccgccgcgttcgtgacgcactgcgggtggaactcggtgctggaggggatcaccgcgggcgtgccgatgctctgctggccaatgtacgcggagcagaggatcaacaaggtgctcatggtggacgacatgggcgtcggcgtggagatggagggatggctggaagggtgggtgaccgccgaggaggtggaggcgaaggtgaggctggtcgtggagtccgagcatggaaggaagcttagagagcgtgtcgaggcgcacagagatggcgcagccatggcctggaaagatggcggctcgtcgcgtgtcgcgttcgcccgactcatgaccgagttggacaatgcacaacgatgaaaatggtagtagtgcataatttctcaaccgtacgtactgattttttatattgattgtattattcctatattttgaaatatcgataatcgaaatgaaaatgttagatgggttttcatctatcgatgtactgattttatccgaattttttaaataaataaccgtcaatggagacagcccatccaaatgtaataa

SEQ ID NO: 3655 - DNA, 1538 bp, Hordeum vulgare
atcaaaccaacgagagcactacaaaaagaaaggggaggagccagaggccataccacaactactactgcctccggcggcagcccacggaatcgtcctcgcagcaccagcggctctccggcgacaagcgcgaggagatggccaaggaaggaggccccgactggaacggcctgctcaagtggagcctcgcccacggcgccgacggcaccaaccctccccgcgcgctcagcgaggaggacaggaaatggtttatggaggcgatgcaggccaacacaattgatgtcgtcggcaggatgaaggagatcgcccaggtgatgaaaacccctgatgatgtgttgcagtctcatggcgtcactccagggaacattgaagatatgcttgatgagttacaagagcatgtggaatccattgataatgcaaatgatcttcattctattggtggactagatcctctacttggttacttaaaaaattcacatgctggcatccgagcaaaggcagcagaagttgtgagtacggttgtccagaataacccgaaaagccagcaacttgtcatggaatctaatggacttgagccactgctgacaaacttcaggtctgatcctagcacgaccgcacgcacaaaagctctgggagctatctcttctctgattcgtaataatcagcctgggcttgccgcatttcgtctaggaaatggccatgctgcactgaaagatgcacttggttctgatgatgctagacttcagaggaaagcgctgcatctcactcagtacctcctgaacaacaaggcggataggagcgtcgctgaagagatcggtcttccgaatcaactgatacacctcgcatccagcgaagattctggagtccgagaggctgccctaggtggcctcctcgagctggcgcgtgacaaggcaccagttgcccgcaacgctctacctgaccaagacaagctgaaggacgtcctgaggagccgaatcgaaggcatcagcacaatggacgccgacgacctccaagcagcccgtgaggagcggcaactggtggactccctctggaaggagtgctatggcgagccgtcgtctctcagggagaagggcctggtggtgctccccggggaggatgagccgcagcagccgccgccagacgtcgcggggaagatgttcgagccgccgctccgtgcgtgggccgcgccgaggccttcttcggcagaggactccgattcggccagcgggaagaaggatccgcccctgctgctaggcccgtgaggccgtgaccgtctccggctctagttcttggtggaacccagcggatattttgggaggccgaagagcgtgttgatggtagaagtctagcgattctgcctgtaggaacctttatttgccccaatggttgtactacgctggtcagatgtgcggttgattcgagtgttttttcctgcaaatttcacagatgcttgtgttattatcctttgcctcttgagcgatgatactgctatacacttgttatacagtagacacaatctgcaagggaaagtacactgaagt

SEQ ID NO: 3656 - DNA, 1533 bp, Oryza sativa
ggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccgtgctccgggagttcctccgctcgctgcccgccgtcgacgcactcctgctcgacatgttctgcgtcgacgcgctcgacgtcgcggccgagctcgccatccccgcgtacttcttcttcccatcccaggccagcgcccttgccgtctttctccacctcccgtattactaccccaatctgccgacatttatggagatgggcaaggcggcgctcctccgctttcccgggatgccgccgatccgcaccgtcgacatgccggcgatgttgcgggacaaggatagcgaggcgaccaaggttaggttgtatcaattcaagcggatgacggaagcgaagggcgtgctggtgaacagcttcgactggctgcagcccaaggccctgaaagcgctcgccgccggcgtctgcgttcccgacaagcccacgccgagggtctactgcatcgggccactggtcgacgccggcaggaaatcaaggatcggcggcgagaggcacgcgtgcctcgcgtggctggacgcccagccgcggcggagcgtcgtgttcctctgcttcggcagccagggcgcgttcccggaggcgcagctgttggagatagctcgtgggctggagagctccggccaccgattcctgtggaccgtgaggagcccaccggaggagcagtccacatcaccggagccggacctggagcgactgcttccggcggggttcttggagaggacgaaggacagaggcatggtggtcaagaactgggtgccacaggcggaggtggtgcagcacgaggcggtcggcgcgttcgtgacgcactgcgggtggaactcgacgctggaggcgatcatgtcggcgctgccgatgatatgttggccgctgtacgcggagcaggcgatgaacaaggtgatcatggtggaggagatgaagatcgccgtgtcgcttgacgggtacgaggaaggagggttggtgaaggctgaggaagtggaggcgaaggtgaggctggtgatggagaccgaggaagggaggaagctcagggagaaactggtggagacgagggacatggcgttggatgccatcacggaaggtggatcttctgaaatggcatttgataagttcatgagagatttggaggagagcagcttggagaatggagttcgtagctgattaagcagagtaaggctcacgattgcattagtgtatcaatggcgtcagttaccatgaaatgtttgcgatttttgctacggaattgctattaagttcag

SEQ ID NO: 3657 - DNA, 1854 bp, Zea mays
actttaccgggctaccattcctgatccctccctccccctctcctcttcttgtcgccgtctccctgcagcgttacgctggcggaaaagaaacggagcgagcgagatcaactggcggctcaagaaaccagagggaggagtgagtgcacgcaagggtcagagaagagccgagagagcgcgcagcagtgcagtggtgctgtatccgctgcattcttcctccccctttggattccctgactcgcatggtatctggtcagaaaggcacaggctttagtgtgcccgttgctgttgtaacgcccctgtctgctcctgcggaggagaggtgcgcgagacgagagacgcgggaaggagagggacggaggcggggaggagtagtggtgaagtcaatgccgccgccatcgccgctcctccgttcctccgccttcgtcgtcttgctgctcctggtgtgtcgcccgttgttggtcgccaatgggagggccacgccgccttctccgggatggccaccggcggctcagcccgcgctgcagcctgcacccaccgccagcggcggcgtggcctccgtgcttccttcggccgtggcgcctcctcccttaggtgtggttgtggcggagaggcaccaccacctcagcagggagctcgtcgctgccattatcctctcatccgtcgccagcgtcgtgatccccattgccgcgctgtatgccttcttgctgtggcgacgatcacggcgagccctggtggattccaaggacacccagagcatagataccgcaaggattgcttttgcgccgatgttgaacagctttggctcgtacaagactaccaagaagagtgccgcggcgatgatggattacacatctttggaggcagcgacagaaaacttcagtgagagcaatgtccttggatttggtgggtttgggtctgtgtacaaagccaattttgatgggaggtttgctgctgcggtgaagagactggatggtggggcacatgattgcaagaaggaattcgagaatgagctagacttgcttgggaagattcgacatccgaacatcgtgtcccttgtgggcttctgcattcatgaggagaaccgtttcgttgtttatgagctgatggagagtgggtcgttggattcgcaacttcatgggccatcacatggttcagctctgagctggcatattcggatgaagattgctctcgacacagcaaggggattagagtacctgcatgagcactgcaacccaccggttatccatagggatcttaagtcatctaacatacttttagattcagacttcagcgctaagatttcagactttggcctggcagtgactagtgggaatcacagcaaagggaatttaaagctttctgggactatgggctatgtggctcctgagtacttattagatgggaagctgactgagaagagcgatgtatacgcgtttggggtagtacttctagaactcctgctgggaaggaaacctgtcgagaagatggcacaatctcagtgccgatcaatcgttacatgggccatgcctcagctaactgatagatccaagctcccgaacataattgatcccatgatcaagaacacaatggatctgaaacacttgtaccaagttgctgcagtggccgtgctctgcgtgcagccagagccgagttacaggccactgatcaccgacgtgcttcactcactggtacctctagtgcccacggagcttggaggaacgctgaggatcggcccggaatcgccctacctacgctactaagaagcagtctcccatttgagtcgaatgaaactatctctcatggagtttggaattgctggttcagtatggctcgtccaagtgtggtccagataag

SEQ ID NO: 3658 - DNA, 1930 bp, Zea mays
gagcacaggtagggtttcggccaccagccatggccgactccgcgccgtccatcccgggcgtcatcgcctccctccaggcctactccacggccctctccgcctttaccgccgcatggcgtgccgtcgagacccacgcctccaccctcgactccgccctcgccgcccgcctagccggcttctcggagctcgagctgatctgctcggcgatggacggagccggcctccgcgcgtacctcaccgagcacagggacgagctcaaggatcccacgcgcgccctcgacgcagccctccaagttgcgcccgacccggggcttctggtcctctccgcggcagcgagtttctgccgcacgctgccggaggtggccaagagcgacggtagcgtcaaggcgtcctgccgcctgctcatcgccttgctcgaccggctgcgcgcgattggtgtcaagccgtcgcctgaggcgcgcgaggaggccagagctgttgcgacggactggaagcgaggcaagcggatcgggacggagacgatgtttaagcaggagacgttcgccttcttgcatctcgtgggagtgtttgggctcgtggaggatgtgggcggtaccagcgaggtgcttgatcttgtcgtgtcgatctcaggtcgtgagcgcgccgttgatgcgttcgtcgtcctgggcctggacctcgaccagcatatgccaatcctcattcagaaaatggtaaacaaaaacaaacagctagaggcagtcaaattcattcaagctcttaatatagcgcacaaatacgctttgttgcctattatgagatcgtacattgatcatgccgcagttgctggtaagatgatccgcatcaggggagatgatcttgctactcagaatgcagctgatgcaaaagagcgcacacttattggaacattgcagaagttcattaaggaacagaagctagaagaactgcccatttttgaagaagctaacaagcgaatggcacatttggatcagcaaagtgctgagagaaaaagaactgctgctgcagcggctgcggctgctcgaaaggttagtaagaacattgaggagcagcagaaaaggatacaggagctgatgcagcctgctaagagaccaaggtctgagaatgtggtgaaaggatcttcgggccagaacgtgaactttgctggaacctctactcaacagtttaagccacaacagagcattcataaagctggagtgtcaaatcagtatcaagctgctttaacccagaatgtactgccagcaatcgctcagatttcacagctagttgctgggagccatcgtccagttggcatcccaaatcaggcccttgctgttccgcctcaatatggtagtggtagtgcaaattattatggagtgacgtccaccaggccatacaggcccatcactctacctcctggacctggtgctttgaatggtccaagtgcgcaggcatcttcaagatcaaggctctattctggagatccccttgcggctgtctcccgatcatcagataagaagggatcgtcttacaagtattctttgtccagtatgtcaacttatgatcgtaaatgaggatttgttttatctgccagtggacgaacctagtgaaccttgaaagtttgggtttcagaccagagatttggtccctccgtagatgttaagtcattgtagctaacaatgggccttttttacagtaaaggatgtgggtttgtatctagaagagattctcctacagagtctaataaatattgtaggaattctaacttataaggacaagttaggtgtaatggtgagagttatcttaccgagccaccagatcctaggtttgaagtagcctcttcctattttcattgggtcatgaatttgtagtatctgtatttgcagcggaaagcttaccttgttttatgcctttgtcgtgtgagtcttcggtagtg

SEQ ID NO: 3659 - DNA, 1086 bp, Oryza sativa
aaccctcgcgaatctgagatccccaagaattccttctcgaaaaccctagaggagagcgagagagaagaggaggcggcggcggcggcggcggaagcacatggcgatcatctccgacttccaggaggaagaggctccgccgcggcagcagcagcaaccggcttcggtggcggcggcggcggggagcggcgacgaggtcctcgcggcggagctggagcggaggggcggcgcgatccccttcctccaggcggcaatcgacgtggcgaggcggcggtccgacctgttccgcgacccctccgcggtgagcagggtcacatcgatggcgtcggcggcgagggcggtggtggaggcggaggagaggaaggcgagggaggccaagaggaaggcggaggaggcggagaggaaggcggccgaggccgagaggaaggcgaaggcgcccgcggagccgaagccggagagctcggcggggaaggatagcatggaggtggacaagaaggaggagggcaacgtgaggaaaccaaatgctggcaatggtcttgatttggagaagtactcttggattcagcaattgccagaggttaccatcaccgtacctgttcctcaaggaacgaagtcaaggtttgtcgtctgtgatattaagaagaaccatctgaaggttgggctgaagggccagcctcctatcattgatggtgagcttttcaaaccagtcaaagttgatgactgcttctggagcatagaggatggaaaatcgctgtccattttgctgacaaagcaaaatcaaatggagtggtggaaatccgtagtgaagggtgaccctgaagttgatacacagaaggtggaaccggagaacagcaaactcgctgatttggatccagagactcgacaaactgtggagaagatgatgtttgatcaacgccagaagcagatgggtcttccaacaagtgatgaaatgcagaagcaagacatgctcaagaaattcatggctcagcacccggagatggacttctccaatgcaaaaatagcttagaacttataaatcgagagtgaccagcagtatggagaaggttggagatgctgaatggagaacta

SEQ ID NO: 3660 - DNA, 1101 bp, Zea mays
aaagcagttccagccttccaaagctgccgccgatgcaagctccgcgtgagggctacgggctggccacgatggacttcgagtacgtccccgcgtcccccggcagcagcaggtgggcgggcgagtcagcggcgcggcggcggcagcgccgactctcttcgccgtcattgaggacctacctcacgccggccttcgacgccgtggccggcggggagggcggcgtgtctgggtactcttcatcgtcgtcctccggcggtctggaactcgggttcgacgcctcgctcctccgctaccgccgctcctgcttggcggcctccgcggacctggatagccgtgtcctcctctactccccgcagtcgttgccaccgccgccgccgcagatgagggcggcgtatatgccagcggatgacgaggtttgggcacctggcgtcagccactacggctccaagcatgaggctggccggcttactggcgcaccaggttttcaggattcagaaaaccgcattgctttcgtctccccgtcacggacaagtagcaatcttcatactacagttctcggcgcctccacacccgtcaagctccctgctgaactccagttgcccgagggcagtgcagagctcccaacgccaaagccagaagctacgccttcagctctcaagttatctgctgatccagaaccagacgtggatgccgatgaaatcactgaagccctgtacggtggcagtggtcatcgcaggctccccattttcagggagatctgtccagaatgagtgtcagcctcagcattctcctcaacgtcgctgatggatgcatttcggctttagatgtatattctgtttatctatctcgtacccatagtcttggtagcagttactctggagggtcatttctagcttcctaaaggagaatctcttctattgatgtcttcattaagcgagaaagctatgatatacatgacttgattaagcaggcaattgacccgttttgcttggcgttggttggaggtgcacgtgcaccttcgaatatatatgaatttagcccctctcttttttttggccctatgtaattgagttgcagtgttttgcatacattcgatgacccgtg

SEQ ID NO: 3661 - DNA, 1486 bp, Zea mays
caccttcttcccagatcaataggggcgaggcgacaccagcgaggagacgaaatcgtttaaaggcgccagcttgtcttctgttccatttgtggtttcatttcctctgcaaacgatttccattttttctgcacgccgtcagctgatccttttcgccgtagtatccccgagcaaaagagaaaacccttttttttgtgcgctgtgctgtttcgccatctctgttcgtcccaccgaggcaccgactcaatccccattcttggcatctggcttcacaaaacaagaccggttcccgttccctagatctctgcgtagaggcggcggcgaggcacctgaatccggcaaaaaagggttcgcggtttggttgggaggagcgcaggagcccggcgtcaaaacccaatcttggcgcccgggctgccgtgcgccatcgtcttctccctgtggtgtttagggagaggagaaggccggtggagatggtgccgtgggaagggtacgtcagcgacgagacgatgggcaccttctcgcccatcgtgctctactggctgtacgccggcggctaccagctgatccttcaccgccggccgcttgagcggtacaggctccacacgcgggacgaggaggaggagaagaacctcgtcagcctctccaccgtcgtccgtggcgtactcctgcagcagctcgtgcaggccatcgtcgcgatgattttgttcatggtgacttctgatagctcaataactgttgttcagccacctatcgtcgtccagatcttccagtttctagttgcaatgttagtgatggactcatggcagtactttgtgcaccgctacatgcaccaaaacaagttcctgtatcggcacatccactcgcagcaccatcggctgattgtcccttacgctatcggggctctgtacaaccacccactggagggcctgcttctggacaccttaggaggcgccatctccttcttggtctccggcatgacgccgaggaccgccatgttcttcttctgcttcgcagtcctcaagacggtcgacgatcactgcgggctttggctaccgtataacatcttccagcacctgtttcagaacaacaccgcctatcacgacatccaccaccagctgcaaggaaccaaatacaactactcccagccattcttctcgatctgggacagaatgctaggaacccacatgccgtacgacttagtgagcaggaaagaaggtggatttgaagcaaggccgtcgcgagactagcttgaagtcatggaagtgtacaggctccggtgaatgagtcagacagaatatggttttttagctgtcatggttcattttttaaaaattttgtgcagggctgccatttacattgctgtgcagatagtgcatttgaaaatccacacttctgtatgtacccagttatttgtgtaattgattgaacctctggtcgtgatcgacaccttcggagcaatctttggctactactgactgtgctttgtttc

SEQ ID NO: 3662 - DNA, 884 bp, Oryza sativa
ctgccatggccggcagcggcggcggcgaccgcggctcgcccgaggcggagctccggcgcgggttcaagacgctcgccgtgacgcggcccgacccgtccgcggcggtctacgaggtccgcctcaaccgccccacccggctcaacgccctcagcccggacgccttcgcggagatcccgcgcgccatggcgctcctcgaccgcgcccccgccgcgcgcgccgtcgtgctctccgccgccggcccgcacttctgcgccggcatcgagctcggctcccccgggagccccgccacggccccctccggcgaccccgcgcccgcggccgccgaggggctccgccgcgccatcctggagatgcaggcggcgctcacggccatcgagcggtgccggaagccggtggtcgcggcggtgcacggcgcctgcgtcggcggcggcgtcgaggtcgtggccgcctgcgacatacggtgctgctccaaggacgccacgttcgtgctcagggaggtggacatggccatcgtcgccgacctcggcgcgctgcagcggcttccgcggatcgtcgggtacgggaacgccgccgacctcgcgctcaccggccgcaagatcaccgccatggaggccaaggagatggggctcgtgaccagggtgttcaattccaagcaagaattggatgctggcgttgcaaagattgcaaaagaaatatctgagaagtcagcatgggcagtgatgggaacaaaggctgttttgctgagaagcagggatataacagtagagcagggcctggagcatgttgcaacatggaacgccgcaatgctgagatctaatgacctggaggaggctatccaagccttcctagagaagcggaagccagtcttctccaaactgtaatga

SEQ ID NO: 3663 - DNA, 705 bp, Oryza sativa
gagaagctccactcttctccaccccaagagaattgaagccaagcatggagaatggaggggaagaagatgacagagcaagccgatgcaagaggattaccagagaatcagatgcaaccaagaatggtgcagcgaccaagctgcaagctttgaggctcgtcgaggacctctccctcccttctgtgcaggtggtggtgatgagcgccaacatgggctgttcgcactgccgacagcgggtcacaaaggttgtctccaagatgaacgcagggttgctagattacatggtggattttgggaagaaggaggtgacagtgagagggacgatggtgcacaccaagaagaagaggaagcaacacaagaagaagcatgaggaaaacaagaagggaatcgctgcaaactgggagaagaaatcgtcttctcagagcaatgacagcgccaggacgctggcctggtttctacgatgctacagttcatagcaactactactatctagtgcatactatagtctacatatagtgttacttatatactactaatatatatagatatatctagaagctatatagctgctcgattaattgtttatttttctctttagtttcttcttgcaatttctttctttctcatgttttattatttttctttttgattgaaaataacgtatgatggtaggaaatgtgtatattctgcccataactgtgcattata

SEQ ID NO: 3664 - DNA, 1907 bp, Oryza sativa
tcaacgcccaagctagattacataacatgaatgcaggattcagcccacagatcttggcgcagaagcttttgaagctcaataattcacgacaaagtatagagactttgtcacattggtgtgtctttcattatcgacactgccgacaagttgttgaaacatgggaatctgattttcactcagctcctcgtgagaggagggtatctttgctgtaccttgcaaatgatatcgttcagaacagcaaaaaggactctggtagatatgtaaatgagttctggagggtcatccctgctgccttaaacgatgtgtttgtcaatggtgatgattttggaaggaatgtcgtacagagactggttgacatatgggaagaacgtaacatatttggatcccatgggcaaagtctcaaggaagactattctagaaggttcaaggagttcaaatccaagtcgagaaattctagtggggagctgctggaaaaggttatctcttgctacaagcatatgttgaatgctcatgtagacgacgatactctcatgcggaaatgtcaaaatgctcttagctttgttgacaatctcagcaatgaatatgagaacaactctattttagactgtagtaatggatctggctttgtggaggagctgcaagaacaacataacgtcctgagagactccattgaacaattcaaaacatcagaattactcagaggcaatcttatttcttgcttaaaggaagcactccatgaacaggagttcaaaatggaacgggccagaagccagattaaggaagttcaatcccgatataagaaagctgatgacctctgccagaagcttggaatacatgtagaaaggcaggaacaaccgaaccatgggcctaagaactcaggttctgaaatgcatggtagctttggcccaggcccagattcagctaatgccagttcttttgagaagggacaatcaagtgcggtgatgtattcccaggagaacggcggtgagcatgagatccccaatggcgttttctcttcacgggccaccaaggataacattgagcagaaactagaagagcactctacgaataagagacagaaactacagaatgatgtgtatgtttcacggcctcaatcgccacctccgccactgccatctgatgcatttgaacagccgccgccaccacctgagcatcccccgccaccagagtctacatcgccccctccaccgccaacttctgatccacctccagtccccccgccaccaccgacaacaggttcattcatgccaattccttctgctccgtttgcgggactgccagtacctgccggccctatgacggcagtaccctacaactcttacccagtatttcctcctatgaactatcccatggtcaacatcccacctcccttccctagtgctccaaatactcccccaggtttccagggtttggctggtcccttctatggccctcctttccccgcaccaccaccgccaccgccaccaccgatgaacaggaaatagactagtttcttgcctgcagattagtactgccagccagctttggaggatagccatagacttggcttcactgaagaatatgctcgtgatgattcatcgccatgtgttgtggagcttggaatatactgttcctagtgttgtacattagtcagttggtcagatagtagcggatttaacagttaattagcattagttgttcaggtcatggtcatgaagcaaaaaggaaaaccatgtgtgactgctagaaagaaattctggagttatgagttatgacagctgaaggcaaatgccatagcatgacatcttttgttactcttcttttttgctcttccctagaaaatgtttgtcacattttgcttgtgttgtttactagattattatgtccatagttgttgcaatgttgag

SEQ ID NO: 3665 - DNA, 528 bp, Hordeum vulgare
gcagccacacaacactatctcctcggtacatcagagcctcccagttagcaatatggcaaagtgtctcgccgccgcgctcctgctactggtggtgctcgcgtactgcgacggtagggagctgaaccagaaggaccaggcactagcaacggcacgcggtgccggtgccggtgccggtgccggtggtggcgtcggcgaggagaagatcttggggttgccagagttgccgcttgtgggaaccgttaccggtaccagcaccgttaccggtccggtggtggtgcttcctgcccttcctgggatccctgctcacccatgatcatctccagttcatgtgctggcttacatgctgaagctgaacatgtggctctagatctctagcaagcactgtccggacgataaacgccggcaggaacggcgtttcgctcatttcatgttccttaatgagcgtctgtatcaactatcctatcgtctgtattttctttcagttcatgtcctagtattttccgttccttatgtgctatgtatcgtcaa

SEQ ID NO: 3666 - DNA, 2207 bp, Oryza sativa
tgccacttgtgcgaggagccgattcggataaaagtcaggaaggatcggggtgtataacaaacaaaacctaaacgagccaacacgcacgctcatcgcatctttgcgtgcgccgtgcagccgccatggacatagacgacgacgcccgccaccgccgcgtcatcatgtcaagggattgccggagtcgcacgccgtcttccaggacgcaagacaagaacagatcgttgctccttgacaaggttcgtgcctcccacgcggaggcgctggaacggctgcggccggcggcggacctcgacgccggcctctgcttcggcttgctggatcccgtctccaacgccatcgtcaacgccgccgtcttcgccgaagcggaagatgggaacgacaggacggggcgatctctcgacggcgcggtcaccttcctcaccacgttcttccctcacctcccggactgggaggccgtgcgctacctgctcgacgccgacgctgacgtcctcgtcgcggcgcgcctcgtcgtgcgggaccgtggactgaggagattcgggttcgcctcggacaccgccggcgccgccgtaaggttggccctcagatgcgccgcgctggccgtgaagcatccgcatcccgaccggctcgtccacgcgtggctgtccctgtctcgccgcctcgacgaggccgtgtccgcgctcgccaaccacgacgtgcgcggcctcgtcgcgctggtcgtcgacgaggcggaggcgccggcggcggccaacatggagagggcgtgggagctggcagcgtcccgatttctcggccgggacaacggcatcgccgcgccgccttaccggcacgccatgcctctccagaggacgctcctctacgcgatccaggggttctacctccgggcgctcgcccggctgccctccggcgagctgcggtctcactaccaccggagcctggtgaaggccggccattgctacggccccatggaccccgtctccaacatcatcctcaacgtcgtctggtacgacgccgcgcacccgccggtggaagagctcgagctggccatgatcccgcccaagagcatgtccagcatcgccacgcgttccttcctcggcctcgtctccttcctctgcacccgctaccccaacctcggcctccatgacgccatccggtgtttgctcgacttcgacggcgacctcaacgccgccgcaagagaagcagatcggcggcagcaccgtccctcctgcactatccaggagtcctacgccgccgccgccgcggcggcccggcaccccaaaccggacgaacaagtggagttcctcagctctagcagagccatgacgacgccgctgctcctgcagaacggcggccagctctcctcggaagacgttcgccgcctcgccgccgccttactgcctccaactccctccgccgccgtctcgccaatgcagcgcaaaccaacgaaaccacggcggcgaagacagctcaaactgaaggcgcagatcatccgtgatcagaacaagatctgcaggaaggtgaaggctgcattggacagatacgcgttgcagaacaacgaacccggtggttacgagctccatgtcatctgtggcatgaacaattgcgtatcaggacccgtgtattgcactgacgatgacatcgtcagttatactcctctgatatactttcgttgtcatgtcaatttcttggctcgccggagagactccgatccatctgccattgccggcgagggagctcttcaactcttctttgcagaatgcggtaactatcgcctcaaccacgacggcatttgctgcccagtaaccatatcgccaccatgctcagaacaagtgcgttgcctttactgcgaacatgaaggggttgggattatgcatccgtcgatagaaaatttccatgggcgtgaggtggattttgagaagatggtatgtggagaagatacctgcggagacgaatttgatccagaaattgatgaggaaccgttttacaccaacgatggtatcgttaatagcctcaaagtgaatattttgtccgggttagaagaggaattcatttatcgcaatagcgatgaaggcaccgacgaggaagaaggtgactctgatgatgatatcgattttgtgtgagttttcttttttttttacgaactggcaaaagaatttgtcaatttcattgagaagaaaaagaataacatgattgtacattttgattggtga

SEQ ID NO: 3667 - DNA, 2104 bp, Oryza sativa
gagcaaccacccgtagtcagtgacctaggcggcggagggagatcggccggcggcgagcgacgacgatgaagtacgtgctggtgacgggcggggtggtgagcggcctcgggaagggggtgacggcgagcagcatcggcgtcgtgctcaaggactgcggcctccgcgtcacctccatcaagatcgatccttacctcaacaccgatgctggaaccatgtctccattcgagcacggtgaagtgtttgttttggacgatggtggtgaggtggacttggaccttggaaattatgagcgatttctggacatcaagttgactcgtgacaacaatataaccacgggaaagatctatcaggctgttattgacaaggaacgaagaggagactacttgggaaaaactgttcaggttgtaccacacattacggatgaaatacaggagtggattgaacgtgtggcaatgaatccagttgatggcacagatgagccagctgatgtttgtgtaatagaacttggtggcactataggggatattgaatcaatgccttttattgaagcattaggtcaattttcataccgcgtaggggctggaaacttttgcctagttcatgtcagtcttgtaccagttctaaatgtagttggtgaacagaaaaccaaacctacccaacatagtgtccgtggactaagaggacttggactgatacctgatattttagcatgtcgcagtactcagccacttgaagaaaatgtgaaagtgaaactcgcacaattttgccacgttccgatctcaaatattgtcaatcttcacgatgttaccaacatctggcacatccctttgttgcttagggaccagaaggctcatgaatctattctgaaagttttagatcttcaatgtgtgggaaaagtgcctcgagcacctaagctgactgaatggactgaaagagccagcaaattcgacaaactgaaaactcctgttaggattgccatggttggaaagtatactggcctatcagactcctacttgtcagttttgaaggctcttctgcatgcatcggttgctttggacagaaaacttgtggtggattgggttccttcctgtgatcttgaagattctgcagccacagagactcctgatgcatatgaaaaagcttgggatctactaaagggtgcacatggtgtactagttccaggaggctttggagatagaggggtccagggaaaaattcttgctgcaaaatatgcgcgagaaaacaatgttccatatcttggtatttgcctgggcatgcaaattgcagtgatcgaattcgcccgctctgtcatgaagttgcgtggtgctaatagtacagagtttgatccagctacaacgacgccatgtgttattttcatgccggagggctctaaaacccatatgggggcaacaatgcgccttggatcaaggaggaccttcttccaggccaatacatgcaaatcagctaagctgtatggcaatgcaagctatgtagatgaaaggcaccgccaccgatatgaggtgaatcctgaaatggttccagaatttgagaaggcaggtctctcttttgttggcagggatgaaagcgggacacgcatggagataattgagctaccaactcataggttttttgttggcgcacaatttcatcctgaattcaagtcaagacctggaaagccatccccacttttcatgggattaatagcagcttcatcaggacagcttgaccatttacttcagcaatcttgcggcgttgtcagctcgccagtcagacgtggcaactactgcaacggagccacgaaacaacagaagctataccaaaatggacatgtcaagaacggcctggtgaacggctgctactatgcaaacggcaacagcattcttcatacttagcagcatagctctgcatcaggccattgcacttgagagatttacctgctttgttttttctcccttttttttgcgtgttttttctcctattttttttagggttatggattcgtctctctgctaaactaagaagagattgaaagggtccttagctccagcgacatgaagagccatttccgatgttttaaggagggagaaatgagcacttgagctgt

SEQ ID NO: 3668 - DNA, 2060 bp, Oryza sativa
ccgccatctactcggagctcccggatcgaggggagcgctcgccgccgccgcagcgacctcgccggatcacggcggcgggggccgatcgatcggaggtcggtcgattgccttcggcgggtgggagatggatggcggcgtgggaggcgcgcacagctcgcggaggagcgtgtcctcgtcgaccggatccaggaggagggccgggcccacggagaacggccaccacgacgccgccgctgccgccgccggcaggaggtcctccgcttccatctcccgcgcctcgcagcagtcgatgaccggggagaggaccgtgaagaggttaagattgtccaaggcactgacgattccggatcacacaaccgtctacgaggcttgtcggaggatggctgcacgcagggtggacgctgtgttgctgaccgactccaatgctttgctgtgcgggatccttactgacaaggacataaccacaagagtaattgctcgcgaattgaagctagaagagacacctgtttcaaaggtcatgacaagaaatcctctctttgttctgtctgacacactcgcggtcgaggcattgcagaagatggtgcaaggtaagttcagacatttacctgtcgtggagaacggtgaagtcattgcactgctcgacatagccaagtgcctgtatgatgctattgcgcgaatggaaagggcagccgagaaaggaaaagccattgctgctgctgttgagggtgtagagaagcactggggagcttctgtgtctggtcctaatacttttattgagactcttcgagagcggatgtttaggccatcactatctaccattatttctgagaattcaaaagtggtgactgttgcaccaactgacacagtgttgacggcatcaaaaaagatgcttgaagttaaagtaagttcagcggttgtagcaattgaaaacaagcctggggggattctgacctctagagatattttgatgcgtgttatagcccagaatctcccacctgaatctactactgttgagaaggtcatgacccagactcctgaatgtgccacggttgacactccaatccttgatgccctccatacaatgcacgacggaaagtttttacatttgcctgtcttagacaaggatggaaatgttgtaactgtagttgatgtccttcacataacccatgctgcaattgcaactgttggaaacagcgcgggatctggatctgaggcgacatcagctatgatgcagagattttgggattcagcaatgtccattggacctcttgatgatgatgatgactccagaagtgaaggatcaactaaagtggcgtctgaggcaacagatgtaggaagatcagctttttatccggcttctggtttgtccaacacattcgggttcaagattcaagacaaacaaggcaggatgcacagatttaactgcgaaacgagcagcttgacagagttgataaccagcattctacagaggcttggcgatgacatcgatagaaaaaacctaccacaaattttgtatgaagatgaggatcatgataaggtcatactttcatcggacagtgaccttgtagctgctgtggaccatgcaaggcaaatcggttggaagagcttgaagttgcacttggattacgccggtgttggtcgccggaagagaggcggtggtggcacttcagacttcgagtacgctggaaaggatgcgtgggcttcagcctacagcgctgtggctgcaggagcagctcttgttgcaggccttggcgtgatggcttacctgaagagagcaggctaggcttgcagctttgcagttgcagatgcagatgcagatgaggctttcatcttgtgatgatgatgatacgaaatgttacagaatcaaatttgagcagattggtgtgtaaattaattcttgtggggaaaaaaatctgtaataatctcacggcagcggatggctgcctacatataatgacgaaattttccggtggctaaaaaaatgtctggtattcagcttgtatcgccactgtacaatgaagcaaatgctctgtactatgtgttgggacagtgtgaattct

SEQ ID NO: 3669 - DNA, 1890 bp, Oryza sativa
tgattgcgtttccttaaatatgcaaggcaggtagagggccgggtgagaaattttgagatttcgacccacagagggcggaaaacccttggattttagattcactcaaggcttcgtcgcgtcatgggtattttcaagttgaatctgctcctaaagctgcagcggcagcggcagcgccgtcgtcgccaaatccaagcccgtaatggatcagttttgattcatccacgggataaaataaacgctccagcctgtcaaaataacacacactcttggagtggccaagcgaagtgttcagacccaacgcttccggaggacatctcgtgtcatatacattccctgatgtctatgcgggatgctgctcgtgttgcctgtgtgtctcgggcgtttgcacgttcctggagatgccttcccaacctcgacttcagtgaggaatcattaggaataaatagaagtacatgcaaaaaagatgagaaactgggagatttgaccagcaaaattgattggattctgaaaaatcactcaggcattggcataaagaaactcatcattcaggttggcagtgtatacagtcgggacagtagtcatcttgctcatctcgatagttggcttcagtgtgctgttaaaccagggattgaagagctgattgttaatctgtcatcaatgaatgcaaaatacaatttcccatgtgaacttttatctagtggaactggagattcacttcgctatatttatcttgcctcttgcaacttccatcccacagtaagaattggttgcttgaaaagcttgacaagactacagctgtgtatggtgaatatcacggaaaacgagctaaggtgccttctttccatttcattgggtttggagcggttggaactcaggcactgcagtacgttaaaatgcttgaaagtaccatgcctgcagcgtctcagctacctagatgttatgacttgcaccgggctgcaagttatagagagcaaagctccaaatctctccagtattcgctttgaaggtgacctctatgtacaattgtcacttggtgaaccactgcaaattaagcaattgtacaggttatgtaatgatgctgccttttatgctcgtactgagctgccatccagcatgccaaatcttgaaaggcttattatacattctgacactgagatggtcaatacaccaatggtgcctagcaaattctatcacctcaagtacttgagtattgcccttggtggacagacctatgattacctttctctggtttccttttttgatgcttctcctttcttggagacttttatcttgaatgcactccgagaacgcacggaacgtgccacaatttttggggatccttcaggtctgaggatgatgccagagcaccgtcatgacaaactcaagtgtgtgaagataatcaatttctcttctgtgaagactttggttgagttaacatgtcacattgttgaatcagcgacagcactcgaatgtcttacgttggacacaacgtcaggttcgcctagatgttctgtgaacagacttggtaaatgcttcttgatgcgcagagagacactcatggaagcccacagagcactcaaggctgttcaaacatacatcgagctcaaagttccctccaaagttgagttaaacgtcttggagccttgcagccggtgccatgctcttgacctttagatgtcaaatatgtgcgtgtggttgttcttaataaccagtattgcaactgtcagttacaagtgttgttttattaaacgtacatttgccccgaaactatcaggctatcagccctgtttactgttgaggtttgtaatgacatggatgtggtaatgtttcattctgttatttctcttgagacttatgattctttatttgctgtgtttgtaggattgattg

SEQ ID NO: 3670 - DNA, 1511 bp, Oryza sativa
tgttaggaagtgaggactgagctttcctctccttcactcgtactgtttctgatatcattgattgctatcctcctcctcctccttcctcccctaaatctctagagaaatggaggacaatctaccagtcaatgtccgggagtatcaagaactcgccaaaaaagcgttgccaaagatggcttatgattacatcaatgggggagcagaggatgagcacacactgagggagaatatcgcagcatacacaagaattatattacgacctcgcgttcttgtggatgtgagcaagatagacatgtcaacaactttattaggatacaccatgcgttcacccataattgtggctccaactggggggcacaaattagcacatccagaaggggagaaggctacagcaagagctgcagcatcatgtaacgccataatggttctttccttttcttccagttgcaagattgaggatgttgcctccagttgcaatgccattcgcttttatcagctatatgtgtataagaataggaatgtttcagcaacattagtacggcgggccgagagttgtggattcaaggcacttcttttgacagttgacactcctatgctcggtcggcgtgaagcagatatccgaaacaaaatggttttcccacggagtggtaatctcgaaggtttaatgacaatagatgaccatgataccacaaacggttctcagctcgaacgattcgcacgagcgacgctggatccatcattatcatggaaggatatagagtggctcaagtccataaccagcatgccgatctttctcaagggcatcgtcaccgctgaggacgcgaggagagcagtggaggccggggtggccggcgtgatcgtctccaaccacggcgcgcggcagctggactacgcgccggcgaccatcgccgccctggaagaggtggtcagggcggtggccggcgccgtgccggtgctggtcgacggcggaatccggcgaggcactgacgtgttcaaggccctggcgctcggcgcacgggcggtcatggttgggaggccggtgttcttcgggctggcggcgaggggggaggcaggcgcgaggcacgtgatcgagatgctcaacggcgagctggaggtggccatggcgctctgcggctgccggagcgtcggcgagatcacccgcagccatgtcatgaccgagggtgacaggatcaggtccctgctctgatgaatcatttctcatctggccaatgcagcttcaggtctaaaaatacaagtgggctatgggccaacccgtaaaccgatttataggtaataaaatttgaccgacccgtgaatctatttatatgtaaaattagtgggtaatccaaggcctacttatttggtctataactataagtggcttcgcggatcagtccagttacatcatattcaggtctcaatgtgagagactttagtatatgcagtatattgcaattggatttatggataacgggtagtaacatggttgatgaaatggtgaataattgagc

SEQ ID NO: 3671 - DNA, 329 bp, Hordeum vulgare
gcacaacccttggagacttcttccacatagtaacccgacccaccctttgccaagatgtataacgctccatcggggcaggagatgtcctacacggaccacgtccagaagcgccacgaggagaagggctgcatctacgcatgcgtgttcacggcgctgtgctgtttctgctgctacgagacctgcgagtgctgcctcgactgcatctgctgctgctgcaactagtccatggcctccatggaaggtggccgcaaggcgcagcagagacccaccgacctccgctgcctttcacaataagcatatgtgactagtgtcttagctcgatgagagga

SEQ ID NO: 3672 - DNA, 945 bp, Zea mays
atccggatctccacattccccaccaaaaatcatcctccggacgaaatcagcggcggcggagatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcatcgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaacccgcgctgcgacgacaccgaactcccgccagtcgccaagcgcgtcggagaccacatcttccgatacttcccccgctccgcggtgttgttggtcgataacaagaagcttgaggaggccgtcaaggggaagttttctgatgcggtgattcagttacacaccagggattcatcaaaaagttggcgtcaggctggatcagatggaagcagtcagctggttctaaaagaaccttctaccaatgttgtcctagctgatcatgttacaacaaagaaatgggagaaaattgttgatttcgatgaccaccttgatgatattagcaaggattggtcgaacccaggcctccttgactgagttttcatgattgatctcgctatactgttttggaacttcgctagaaatgaggtggtgaagctcgtcctgctgtgctatggatttctctcagtcgcaacgagttgtaagcactaagcacggatttcattttaatgtaaacgagtgattttgtaacaattacagttcaaaatgctaaaattgacgttgtgatgatatttaagtagattcgtcccagccgcatattaattatgcagagaccatgagattgtttc

SEQ ID NO: 3673 - DNA, 2785 bp, Oryza sativa
actgagctctctgctaagttggtgcctcagctgtgtatcttgcagcaagagtgttctagccttctaggctgccaagatgaagtccaatgcggttacctccaaaggcaaggccgtgttcgagctgaagcacaggctggtccaggccatcaacaagattgcagacagggacacctaccagattggattggatgagcttgagaaggccgctgacaccttgcctcctgacatggttggtcccttcttgtcttgcgtggttgacaccgatgccgagcagaagagtgcggtgaggaaggagtgcatcaaggtgattggcacattggctcggtcccatggaagcctagtggcacctcacatgacgaagatggtgaccagcattgtcaagcgcctcaaggatgctgactctgttgtgagggacgcctgtgttgatacctgtggtaccctcgcattgtgtgctagaggctatggggatggtggcgctgcattggttgcgttggtgcggcccttgtttgaatcacttggtgagcagaataggtatgttcaggctggggcagcgtcttgcttggccaaggttattgacgagagcaattacttccctggccctgttctgccgcagatgcttgttcgtgttgttaaactgctcaagaatccccatttcatggcaaagcctgcagtgattgagttgatcagaagtattattcaggctgaaggtgcttctacagagcagtctttaacatctgctctaacaagtattatggatgccctgaagagtagtgattggactacaaggaaagcagcttcaatagctctatctagtattgctctcagttctggatatctggttgcctcctttagaacttcctgccttcgctcccttgaacgttctaaatttgacaaggtcaaaccagtgcgtgatgcaattacccaagccattcagttgtggaaggttattccagggtctgatactcccgagccatcagaagctggatcatccacaaaagaaaacttctttggtgaccatcatgatggtagaagtataaatgatggtggatcacgagacacttctttcaggagagttgatcctgcatcttctgtttctgcaatcagtggcaattctattacttcatcaaagaagagatctcctctgtctatcaataaaatagccctgaataatgctgcaaatcagcaacgctcgaagttgagcgattggcatgttgagatatctgttcctaagcagaatatgataccattagttgattttgaagaaaaggtgtctggcaatggttccatgctaaagggttcaaatagaagtccatatgaaatcgtagacaatgacagcaagtatgagtatgaccccatggatgataaacaagattgctcctctatgtcagaagtagccagcaggagttgtgagacaaagcatgtcacttctgctcaggaatgcgttgaggattgtgattctgcaagagacattgagcaattccccagggctcaaaagagtaagagcatagactccactgttacagatatcacttcacatgggacacatacttgctgtttgggtgcaatgaaagaactatctcatatcaggaagcagcttcaagagatggagaggaagcaagcaaatatctttgatatgttgcaggaattcatgtctaactcagtggagaacatgtcagtattaagcatgaaagtgcataatttggagaatgctgtagacaaaactgtgtatacaattactcaaagtgaaagccgctatcaccttcctggttccaagtttattaagaaccaaagtgccacttcttcaccgagggtttctacttctacacctagatcatctgtggatgctaactataagccaccaccaattcctcatttgaaacaagagaaaaagtggatgcaagatcaaccatcaaagggcttaaacatgggtgtaaaagagggggaatttctaaagagtcatactcatgacaaaactagaaagcctggggttgtgagatcggaaagtgctctgggaagatatgttccaagctcagcaaggactcgagcatcaggggttaagggaaactttccagtttcacttaccaattcctgtgagcagcctgagctgcaaaatgcattgcgtgcttctaaagaatttgatggtaatgatgacatggcgtctgcatatgtagaagccctgaacagtggtgactgtgattatctgattgacgtaatggatagaactggacctgttcttgagaaattgtcacgtgaaacaacaagtgaacttttgagggttatagctggccagtttctgaataaaaaaatgtttgatttggcattgccttggcttcaacaggtagcggatttgagcatgatttataagccaagtcaactttttgtgtctgtgagagcacagaaggagttccttgctttattggaggaagctgcaacaagtggatctacagagccagcaatcagaattgccattgcacagcttgcatttaaactgacaaaagtctgtgaggttgcaccatgcaggaaagttttgagtagagtgtgcagaggaaatgaaactatcatggccactgcgatgtgaaatacttcccctagcaatgtaccccctagtgtatgttcaaacttcaatgtcatgctgcagtgattgagtgcacccatttcattttgttgtagccctgtaatctgtgtgacaatgtatactcggtttgggtactatgtgcaagactagatgagttctgcaaattcatctatagtttgctagttaagcttggatcttctgttgctagga

SEQ ID NO: 3674 - DNA, 1248 bp, Oryza sativa
agcttcctccctagctgtccgcgactccgcgaccgacggcggcggcggcagatggagaggaaccagcaccgcgacggcgacggcgacggtgagggacgccatcatcatgtcgtccaggtcccagcgtcagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcgatgctcacagcgttcccggcgtcgagcctcctgtcgcggctgtactacaacaacggcgggcagagcaagtggatcctgtcgtggtccgccgtcgccggctggccgctgccggcgctcctcctgctgccgtgctacctcgccggcaaggcggcgccgacgccgctgtcgccgaagctgtgcgcctggtacgcgctgctcggcctcctgagcgccgccgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtccgggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaatag

SEQ ID NO: 3675 - protein, 575 aa, Oryza sativa
MATSWSVAFTIFFSCILLLETISSSVASLDCSYGSAQVKILSSSVVSEQQNVYLFLKPFQSTRSCSARRLAGEFVNGVVVPNLRLNVTGVVVTANERQLGALRCTLESVQAELAVAGLGRSVKVSPELSLPSLRAMAKCRRRGEKHWRRVMEFVRRSGSFVVVEMGAEEKADLAVADVAAAFEEGVGVAFRISGRAARSAAEMARLIGDADKGRRWTGVLAEVASPSPRRELAAAARTTARDVFAPVTNPTTTPATNPVTVPATNPAMNPVTPGIVTVPSTNPATGYSNNPNLPPLYPEPTPVTMPDPTTTTTPTPFMNPVTAPTMPSPVTNPATTPAVTNPTTMPYPYPPQQGGVMPTTPTYQPPATMPAAGGQTWCVAKAGLMDAALQSGLDYACGMGGADCTAIQPMGACYNPNTLQAHASYAFNSYFQRNPSPASCDFGGAGMLVNINPSSGTCLFQASSAGYGAGYSPGVTGTVPVGGGAGAGAGVGVGVTPMGPAVGGTGGAGVTPMGPAVGGGSGSTVLNANSPGGNSMYGSDSNPTSLTGAAAAALSSGWVLCLVWIFTFAYVKEKV

SEQ ID NO: 3676 - protein, 1046 aa, Oryza sativa
MAFPSGKAYYLHLLLLAILPSLVARRGAAQQGGVDEKQLLLQVKRAWGDPAALASWTDAAPHCRWVYVSCDGGGTGRVTSLSLPNVAVAGAVPDAIGGLTALTVLNLQNTSVGGVFPAFLYNLTAITSIDLSMNSIGGELPADIDRLGKNLTYLALNNNNFTGVIPAAVSKLKNLKVFTLNCNQLTGTIPAALGELTSLETLKLEVNQFTPGELPGSFKNLTSLKTVWLAQCNLTGDFPSYVTEMMEMEYLDLSQNSFTGSIPPGIWNIPKLQYLFLYTNQLTGDVVVNGKIGAASLIYLDISENQLTGTIPESFGSLMNLTNLALMTNNFSGEIPASLAQLPSLVIMKLFENNLTGQIPAELGKHSPFLRDIEVDNNDLTGPIPEGVCDNRRLWIISAAGNRLNGSIPASLATCPALLSLQLQDNELSGEVPAALWTETRLITVLLQNNGHLTGSLPEKLYWNLTRLYIHNNRFSGRLPATATKLQKFNAENNLFSGEIPDGFAAGMPLLQELDLSRNQLSGAIPVSIASLSGLSQMNFSRNQFTGDIPAGLGSMPVLTLLDLSSNKLSGGIPTSLGSLKINQLNLSSNQLTGEIPAALAISAYDQSFLGNPGLCVSAAPAGNFAGLRSCAAKASDGVSPGLRSGLLAAGAALVVLIGALAFFVVRDIKRRKRLARTEPAWKMTPFQPLDFSEASLVRGLADENLIGKGGAGRVYRVAYASRSSGGAGGTVAVKRIWTGGKLDKNLEREFDSEVDILGHVRHTNIVKLLCCLSRAETKLLVYEYMENGSLDKWLHGNKLLAGGATARAPSVRRAPLDWLARVRVAVGAARGLCYMHHECSPPIVHRDIKSSNILLDAELMAKVADFGLARMLVQAGTPDTMTAVAGSFGYMAPECAYTRKVNEKVDVYSFGVVLLELITGREAHDGGEHGSLAEWAWRHLQSGRSIADAVDRCITDAGYGDDAEVVFKLGIICTGAQPATRPTMRDVLQILVRCEQALQNTVDGKVAEYDGDGAPFLPIRGGSRRKQLSDTKGIDDGNGSLDSIV

SEQ ID NO: 3677 - protein, 252 aa, Oryza sativa
MSMAREHFVLVHGEGHGSWCWFKLRWLLESSGYQVTCIDLAGAGVDPTDPNTVRSFEQYDKPLLDLISAIPEDEKVILVGHGSGGLSLIHAMHQFVDRIRQAIFVAATMLPFGLQTDEDKKDGLPTLPENEINLIFGTGADDPPTTAALRPEFQRERLSQQSPEEESVLASMLMRPWPVTAISTASFEGDDERLNRIKRVFIKTERDHMLNPQQQDSMIKKWPPSEVLEIDTDHSPFFSAPEQLFNLIVKSL

SEQ ID NO: 3678 - protein, 169 aa, Oryza sativa
MAAARFPLLVLCLLPIIVCSVVDAELTHLHFYFHEVDAGTPNATVVNVASLHRNSSTFGDVNVFDNALREGPDPASRLIGRAHGLAVHASLDETGGLTAINFVFSDYGAYSGSTLATQGHFITTGPSERSIVGGTGKLRFARGYMTSKLLSSTDTAIVVVFDMYFTLDH

SEQ ID NO: 3679 - protein, 233 aa, Hordeum vulgare
MAESNSYEEQRRRQIEENRRKLEELRVHHLSAAVREAAARPKPKPKPKPKPKAPEPGELRRSGRVASLPEQPNYLNDAEQRDYRGVYEAYAVRKGPTDEQRAGAIAKAEELRRRIHRSRCPAFVKPMSHSLAINEVHMRVPRDFRKYLPAAHGEAVVVVDEADDEFHMMYNAYKKRCHYLEKGWKGFAFDHDLVDGDCLVFHMTERAKFKVYIFRANPDYKSDQTSDESEDEE

SEQ ID NO: 3680 - protein, 102 aa, Zea mays
MAASSKVVCACILIVLVISSHADARRLVAATCNGGTEGGACKGGIFVQGYAGLSARQKMAASATSTEQVVVVGEGMPATTTDSRPTAPGNSPGIGNKGKINN

SEQ ID NO: 3681 - protein, 137 aa, Hordeum vulgare
MATLQLNHIARETGDVRRLAAFYEEVLGFERVPSHAYSGFQVAWLRLPASPDVALHIIERDPSVASPGAEGVPPSQLPRRHHLAFSVADFDGFLTGLRTRGTELFEKTQPDGLTRQVFFFDPDGNGLEVTSSSPGDK

SEQ ID NO: 3682 - protein, 518 aa, Oryza sativa
MAAAAVARRVVLVLVLAAASLAAAPRGAAARSLGGREGPGEVDADAAVDLNATNFDAFLKASLEPWAVVEFFAHWCPACRNYKPHYEKVAKLFNGRDAAHPGLILMARVDCASKVNIDLCNRFSVDHYPFLLWGPPTKFASAKWDPKQENNEIKLIDDGRTAERLLKWINNQMKSSFSLEDKKYENENMLPKNASDPEQIVQAIYDVEEATAQALQIILERKTIKPKNRDSLIRFLQILVARHPSKRCRRGSAELLINFDDHWSSNLSLSSQEGSKLLESVAEENHWICGKEVPRGYWLFCRGSKSETRGFSCGLWVLMHSLTVRIGDGESQSTFTSICDFIHNFFICEECRKHFYEMCSSVSAPFRTARELSLWLWSTHNKVNMRLMKEEKDMGTGDPLFPKVTWPPNQLCPSCYRSSKVTDGAVDWNEDAVYQFLVNYYGKKLVSSYKETYMESLQQQEKKIVSEDSSISNAASVPIGAALGVAIASCTFGALACFWRAQQKNRKYSHHLRSLKKI

SEQ ID NO: 3683 - protein, 207 aa, Zea mays
MEGRRAAVSLVAAVSLLLACSRSPFPVVAADEGETSVGAPDTNQLCVSKCGTCPTICTASPPTILPMTAPPPPALALLPLSAPPPPYLQLVLPPPPTGDVYDLLPPVTPLTSPPESPCTTPPSSSSSSTEPPPSPPSSSSPPPPPPPKSGGDGGSGSSSHFSSPPSSSNPYYYLYLSGGARARGGASSSACAALVLAAFLLAVALFK

SEQ ID NO: 3684 - protein, 366 aa, Zea mays
MADRRSNGGSPPSWSFASQSSHYHLAAMRGSYAPQSLWRPSPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGLFNFNKDRDGYWKWFAGNIASGSAAGATSLLFVYSLDYARTRLTSDYRAAAKGGERQFTGLVDVYRKTLRSDGVVGLYRGFNVSVAGIVVYRGLYFGMYDSLKPVLLTEKLQGNFFASLALGWMITNGASLASYPLDTIRRRMMMTSGEAVKYKSSMDAFAQIVRNEGPKSLFKGAGANVLRAIAGAGALAGYDQLQLIFFGKKYGSGGA

SEQ ID NO: 3685 - protein, 329 aa, Hordeum vulgare
MVWTTVQELAAAVEEPPRQYLVHEQDQGLLAADQMPEPIPLIDLSRLTADDEADKLRAALQTWGLFLLTNHGIEESLMDAMMGASRDFFRQPSEEKQKCSNLVDHGKKSELEGYGNDKVVNQDEGLSWNDRLHLRLEPEDERNFTKWPTHPASFRDVLLEYASRTKRIRDLVFRSIAKILDLDEDYFLNQISNKDPGFARFNYYPPCPRPDLVLGMRPHSDGGLLTIVFVDHDVGGLQVERDGKWYNVPAKPYSLVINLADCMEIMCNGIFRSPVHRVVTNAEKERLSLAVFYAVDGETMLEPAPGLLDDRRPPRYGKFKAKDFGLSLD

SEQ ID NO: 3686 - protein, 712 aa, Oryza sativa
MSDPGEPSKHSQWMSHWTKGSSSAEPQVGRSNDSPEDAKYDICEDNSGPSNFEIMKSRLFERLMVGISQERASLEHGQKLNSNMKVVVKDARRHAVQNQIDQGDGPIQKSVMQKDVLYAKAVVSKSLSIQKLSELSVDCQKLAGSDDLSSEWNHFPMLAINRKIDSILNPKRKSAKSTGPNDVFVPKQTLKLNMTTANLMAFSSQEYELHSHRTTDETMDHCKHAGGIVSRLEDHAGVMLNPAEQKLKGQLLPATSCSCSKDDSNSSDSLLDEQHTSRYIADSDQEPTCRSREKRLKSSENNDTNCKIGSCSQNQKSRAPGHHKHKGSAGVMFRTSVPGKEFEAAEINCSDKINQRHLNTQRIVSAANVTGSCIPDPAADISTVNGRGEAVTQPSSISGDSTKRKAPYLFEMLTIPSKAQNMNPEDSLPSGNSTAFGVHMYGTNIGSHLFGANNKSSTETEILSGDSQHVSKSSAGIASLLAQKAKSEQLATLYMKGASGCNVNEHQGVSSKAIVANKQQCYNPRTARMDLDLMQFQLSRMRNQESQARTEPGDRWLKRLQIDSKDPHHLPCSKRSKAGDGSGRPVTGGASSMAPRCDGSNDDDDIVDRDHKEEQGLDEGVEIQGGREASPVPAKSDDRWIGRWCQGGVPVYHEDDHDQRKEVTKPDLAAGDSGGLEGQFPSIKAMAMMGRAMSKVRPCQQERRGSFMVWKA

SEQ ID NO: 3687 - protein, 530 aa, Zea mays
MAAAAWWETLVVAAAADGTGGSSTTVVSICMFTTVLCLCLVAGHLLEENKWVNESITALVIGCIIGVIVFLLTKGKHSHILRFDEQLFFIYVLPPIIFNAGFQVKKKQFFHNFMTIMSFGVFGVFISGAIVSAGCYWLFPKVGFGELGAVDYLALGAIFSSTDTVCTLQVINQDETPRLYSLVFGEGVVNDATAVVLFNAIKDLDISRLKGGVVLKVIFDFLYLFATSTVLGISIGLVTAYVLKALYFGRHSTDREVALMALMAYLSYMLAELLELSGILTVFFCGIVMSHYAWHNVTESSRITTKHIFATLSFIAETFIFLYVGMDALDIDKWRTSKESFKTSIGIFGILILLILLGRVAFVFPISILSNIMSGSSERTPITFKHQVVIWWAGLMRGAVSIALAYNQFTFSGVTSDPVHATIITSTIIVVFFTTLVFGFLTRPLISGMLPHQSRALSRGHSTGSNSPKDDFTLPFLSGDEGASGSGIVLEQAKRSLSMMLERPVHTVHIYWRKFDDRFMRPIFGGPRSH

SEQ ID NO: 3688 - protein, 244 aa, Hordeum vulgare
MCTLEQRGRVFVLTLTGDGEHRLGHPLIASIRSALASVLAAAQAQPQGPGAALVTVAEGRFFSNGLDIGWAGASRARLGEIVDALRPVAADLLALPMPTVAAVTGHASAGGFLLALCHDYRLMRADRGVLYMSEVDIGLPLPPYFVHVLRAKISQAHALRDVVLRGKKLRAPEAKEMGVVDVVCPGAPETAADALKLAEQLAARKWDGAVYASIRMSMFPDACRAVGIAVESDEEKSKHFASRL

SEQ ID NO: 3689 - protein, 189 aa, Zea mays
MTTTRDRGAGGGSASRVGDGDVDLGEGWDWGAIPRLLSSACLFLCSGGCFGCCDKTVKQLGELSRNLITQDQITIGEPFWSTTTIEVEPADLSGVTSVNTSNLASGTGSSHNLPGLGNNGLILWEHTRQEWTETRSLRLKAKQVREPVLSWNAAYESLLGSNKPFPQPIPLHEMVDFLVDIWEQEGLYD

SEQ ID NO: 3690 - protein, 338 aa, Hordeum vulgare
MATTGSRSTLVLVYLTVAVLVSPALSAPLDGAGFHSATCPQLESIVFSSVQAALQREVALAAGLLRIFFHDCFPQGCDASVYLKGRGTEQAMGPNTTLQPRALQLVEDIRAKVHAACGPTVSCADISALATRDAVVLSGGPNYTVPQGQFDSLAPASQNVVNGLPSPATSSVSALARAFSGKGLRDLADLVALSGAHTVGRTGCPFFRDRAQRMDDAFSRRLAANCSAAPNRLQNLDVVTPDLFDNGYYKALVNSQGVFTSDMVLIKDRTTAPIVQQFARNKDAFFAQFAKSMAKLATAPRPGGNVGEIRRNCFSPNALRAIDTVVEAGEEEGFTASA

SEQ ID NO: 3691 - protein, 240 aa, Zea mays
MTGYRSRSPSRSYSPRRRYSRSPLRRKRYDDPRDRYRWAGAGGGGDRRGYGRPLAQSGLLIRNISLTARPEDIRATFEQFGPIKDVYLPRNFHTRELRGFGFVKFRYPEDAAIAKREMHHQVIGGREISIVYAEENRKTPQEMRMRTRTSGRYMDGRYTRLSRSPRSRSHSYSPPPSPVRRDFRGRGRPDSYSPQYSLSPRPRDSRHHRSDGRSPTPSLDDHKPKATPVNGGHGPAVASR

SEQ ID NO: 3692 - protein, 369 aa, Zea mays
MLRSTGDRVVVVGGGIAGALLAKTLQNHADVVLIDPKEYFEIPWANLRAKVDPAAVERTVIAHSDYLTHAKVVTASAVGLDDSVVLTSIGRAVAYDFLVVATGRTCNRPQKRSDRLEMFQRDKERIDAAESVLIVGGGPIGVELAAEIVMKSPEKRVTIVHGAPRLLKVMGARASAKALEWLRSKNVTVLLDQTVDLASATPDTRTFTTSAGEMLEADCHFVCTGRPVASGWLGGTILGEHVDEEGHLRVDDHLRVGGLRNVFAVGDITDVPEAKQGNLAQRQAMVVSRNLRLLVKGAPREEKLHRYKPSPRTSMTVTLGQRDALAELPFMTLIGHIPGAVKPRDLFITRTRRMMGIKSKPYGTMPHVM

SEQ ID NO: 3693 - protein, 422 aa, Oryza sativa
MVEGPKFAGMMGGVVGGAGGHDDIGGNFCDMAYYRKLGESSNMSIDSLNSLQTSTHGGGSVAMSVDNSSVGSSDSHTRMLNHPGLRGHVAANYSVGHSIFRPGRVSHALSEDALARALMDPRYPTETLKDYEEWTIDLGKLHMGMPFAQGAFGKLYKGTYNGEDVAIKLLERPEADPEIAGLMEQQFVQEVMMLATLRHPNIVKFIGACRKPMVWCIVTEYAKGGSVRQFLMKRQNRSVPLKLAVKQALDVARGMAYVHALGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPVLSEIMTRCWDPNPDVRPPFTEVVRMLEHAEVVILSTVRKARFRCCISQPMTTD

SEQ ID NO: 3694 - protein, 910 aa, Oryza sativa
MKGGSSATAASGGGGNSLAIVERQKPATSCVASLFQMLAKKKLFSSSSKKTKLLPPVCTQKFSPGRPPAGGEKTPAAKMRTLLLDAPYYPNEVTTRLPPPGQDNKSSEMCTPGVVARLMGLSAMPATSHQKAVKTMDASELGGHRSECSYGSIYNSHQKQQKPGHIRDGRHDNGNQLDADAQPVWSRKHAAHKLASPIKSPRSVSSRNKVRLIEAAVKVLEPGLQSRHHHQARRQARLEYRCNSSDVQSAAEAMHDFSDQFAREMCDVDASRSGAQNVGATSLHNSTSNQWSEEDTMRNVSVRRPNQNISCQAQSEGNHKGQRNGFKDSGQRTSDDVLVSSQGVQKIQPKNISRENVDCRPLKQNNLKQNALPETYRAADTGHMVQRQKHRAKEQNVANTANDFVCSNRGMNNSASLRSKGKVKDKIGMPHGSAENRNLSTKCHRTSGLHGDCSNKQISKTATLKATEKDMIIAKGAGLVSEKPKSTSPNSVRNDSRRKVESRIASRGNNSGIISISSNSPRKAVLALLNGHTKGSDSVVLGSPTGSCPKRDYRRDCQNISSERELVLSEALQGISSLESAESVCFNRNELRNREILDDRVMSSLFRKTSAINVMEESPSDEFLWQCNFLDSLTFGFREVPRSGKLRETHKKHEVTTNASDPSYYADDECFSGSLLKTAASEAGFRDRRRSENCTMQQDGTNKRNSRCSETNFGQDSSNLIHPGEVAATVELLLTNVRRSTSTTPPRTSKAPFKAFLVKTFESALTTVTTTSSTKKKKKKNGFSFNAGVVKATEGEKSRSPLGSLAFDSVMECLDSLFTQFCDSGYRSFSRVPLICPEERLAAQVDREIARCSGMAGKEVDELIASDVQHSGVEIGVDVLHEAFEIGAQIERDLLQELVAEIGMDMLRRL

SEQ ID NO: 3695 - protein, 1214 aa, Oryza sativa
MATPLADEGSIAAAVMPRSPSPPAAAAGSAAEAPMLIFVYFHKAIRAELERLHAAAVRLATERSGDVGELERRCRFLFSVYRHHCDAEDAVIFPALDIRVKNVAGTYSLEHKGENDLFAHLFSLLKLDVRNDDGLRRELASCTGAIQTFITQHMSKEEEQVFPLLIKKFSHEEQADLVWQFLCSIPVNMMAEFLPWLATSVSSDEHQDILNCLHKIVPDEKLLQQVVFAWIGGEAVKTISHDFCSPCSKSNVRCKDAIDQTDKYGCSHEHFKTGKRKRAESSYSQLVMHPIDEILCWHNAIRKELSDIVEETRRIQQSGDFSDISDFNVKLQFIADVCIFHSIAEDQVIFPAVNDQVSFEQEHAEEERRFNKFRCLIEQIQITGARSTAVDFYSELCSQADQIMEKIERHFKNEETKVLPQARIHFSSEKQRELLYKSLCVIPLKLLERVLPWFVSKLNDQDAEAFLQNMFLAAPSSEAALVTLLSGWACKGRSKGTSNSGKFICLTPRALSSPLDENGFKDCQLCPCSLQSDICSRPAKKWNDTESSNISNCSQTADIALTCKNSPCHIPGLRVEISNLAVNSFASAESFRSLSLNYSAPSLYSSLFSWETDAAFSGPDNISRPIDTIFKFHKAIRKDLEFLDVESRKLIDGDESSLRQFIGRFRLLWGLYRAHSNAEDEIVFPALESKETLHNVSHSYTLDHKQEEELFKDISTILFELSQLHADLKHPLGGADAVGANHIHPYNRIDWSKKNNELLTKLQGMCKSIRVTLSNHVHREELELWPLFDKHFSVEEQDKIVGRIIGSTGAEVLQSMLPWVTSALSLDEQNNMLDTWRQVTKNTMFDEWLNEWWKRSPTSSGPSSDASHPEEDHFQEKFDQSEQMFKPGWKDIFRMNQSELEAEIRKVSRDSTLDPRRKAYLIQNLMTSRWIAAQQKSPQPQSEDRNGCTVLPGCCPSYRDPENQIFGCEHYKRKCKLVAACCNKLFTCRFCHDKVSDHTMERKATVEMMCMQCLKVQPVGPNCQTPSCNGLSMAKYYCSVCKFFDDERSVYHCPFCNLCRLGQGLGIDFFHCMKCNCCLGMKLIEHKCREKMLEMNCPICCDFLFTSSAAVKGLPCGHFMHSACFQAYTCSHYTCPICSKSLGDMTVYFGMLDGLLAAEELPEEYRDRCQDILCNDCERKGRSRFHWLYHKCGFCGSYNTRVIKIDRADCSTSD

SEQ ID NO: 3696 - protein, 271 aa, Hordeum vulgare
MSLLSKLRLVTVDVTGTLLAYKGRLGDYYCMAAKSAGKPCPDYDRMHEGFKLAYTEMARKYPCFGFAAKMPTIEWWRICVKDSFVKAGYDYDAETFEKVFKRIYSAFGSSAPYSVFPDAQPFMRELREKGITVGIVSNAEYRYKEVILPALGLNQGSEWDFGVFSGIVGVEKPDPQIYKIALEMAGNVAPEEALHIGDSYRKDYVPARSIGMHALLLDRFKTADAESWRKSGAPVLPDLEATKAWLAKNPTEEPAEEPLGAALLRRMAEKL

SEQ ID NO: 3697 - protein, 78 aa, Hordeum vulgare
MEGLIPFIYRAVAQYRKEGQVSLADLLFDDPSSSPTATSAYFRLPGDSGRHQLFSADSGTAARRSPAHRRRTMEHGSW

SEQ ID NO: 3698 - protein, 115 aa, Hordeum vulgare
MAANHHLRRLASASAPALSRLSKPAPSPLLRSAFSSSASPADQPPAAAAQKGEAQSAVKEADEAQGGAGSGATKAAEEDDGGLDINEATGEIGGPRGPEPTRYGDWERGGRCSDF

SEQ ID NO: 3699 - protein, 636 aa, Hordeum vulgare
MSNYYSSPGDERDPQTMYSPETGSASYPVPSALGNLLYSNNASSGPYTEFSGIIQPQQNFMELHGHPSEHSSSREPNMVTSLAEQSSFAPVKDMRNEMLMHFMDGAHSGGGDLIHNDAHSSAQLEFGLLNNPSSAIVPSAPGQGLSLSLNTHILAPSYPYWSPKPDLLTTQSYQGDENGMKNMQSEASRAIRNSKYLKAAQELLDEIVSVWKSIKQNAQKDKVEAGKMDGKDADEVLKSEGVSSNPQESAANAEAEISAAEKQELQNKMAKLLAMLDEVDRKYKHYFHQMQIVVSSFDMIAGSGAAKPYTAVALQTISRHFRCLKDAINDQVNVIRKKLGEEDNSSGREGKLTRLRFIDQQLRQQRAFQQYGMLQQNAWRPQRGLPENSVSILRAWLFEHFLHPYPKDSEKLMLARQTGLTRSQISNWFINARVRLWKPMIEDMYKEETGEAELDSNSSSDNVPRSKDKMASCEDREDQKCSMSQGQAYQTSEFKANVGMVGLTGGPASFHNEASSDDGFMNLLLKDQRPGEADGGLLHGDESARFMAYHLAELGGYQNSNVSLTLGLQHTENNLSAPNNTHRPGFTVGGEGDIYNTTAAHPGGGAAAASPDYESTNQLDQRQQFEPSPLLHDFVA

SEQ ID NO: 3700 - protein, 324 aa, Oryza sativa
MAKKQSLLLAMMLVVAGLAVSAMADRKLMSLVKPQPNQLTYHNGAVLSGDIPVSILWYGRFTPAQKAVVTDFVISLAAPLQAAPAPSVSQWWGSIHRLYLSKAVAVGKNGGAHGGGGGGRAKNARVVLSGQVSDEGCSLGKSLKLSQLPTLAARARPGKGGVALVLTAQDVAVEGFCMSRCGTHGPVSRAGAAYAWVGNSATQCPGQCAWPFHQPVYGPQAAPLVPPSGDVGMDGMVINVASMVAGAVTNPFGDGFYQGERGAALEAATACTGVYGKGAYPGYAGALLVDKATGASYNAHGAHGRKYLLPALFDPDTSACSTLV

SEQ ID NO: 3701 - protein, 362 aa, Zea mays
MPEAEWNDEHTRIVCELFEEQVRAGNRPNTHLNNIGYRQVAAKFQQRTELLYTKLQLKNKWDKFKNDYITWRKLLVVGKGLPWDTAKGTFVADEEWWKKINKELPGARKFRHGGLHHEDKLNVMFDYITSNGVDPSPPAPESPKNGVNHSPPAATGLPSAPDCTLNGVDHSPVTAHGLPSGPYSPMNGMDQLPLPTHDLRSVQEIPMNGVNLDGLDNNTEDNDDIYQEPVFQYTSNRKKRPISFSATKKNKKNKAETALLMQAHLYRITELAQKAQDTFKKFSSQADLVPWPSIQDVMTLVWECGARCGSNEHFIATELFVSREQREMFLTMETAEERFQWLRRKYIVKYLSGTTSTNLGTR

SEQ ID NO: 3702 - protein, 694 aa, Zea mays
MSPDVDAAVATAVAPGGGCGGDGEAGAGTSSSPASAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQKGAVDFLVKPVRKNELRNLWQHVWRRHAMNCQTNGSENNAASNHISANVANGSKTGENSDEESDAQSFGSKRDTEIHSVEAVQDIRRDEVAGSSKNNELQNKSYDGVNTKVDVSKYTNGAPSGSEKNVRSKCLNGITSAKVAEQIMDNALRITDASSRRPTNLGNGLAMTEPAADRKCQSSVMENNAVTENNPGDKSKGAAIGHADSCPSEFMVTNLGKEHHLNGYKNQEFREKDIFNHSNSSAFSRYGNKRIEPSGEIQFFPSPCVIGQGHVNGKNPVFQPNGVLLPPNEHNTGESTRQARISLDSRTEGAAILCSTSAREDAGANSSSHRKDSMSHPSYGFIPVPIPVGATMPYHYGAILQPVYYPQSPLMHCDSAGINKAAIQHASGQPNYHEAPGKPSHVLIEHKQSEENHQLHHSRQILRESGEPIDMARAHVDRANQTASCSQGICKGSGCTCSGEADINANTMVALESGNESGIQNGDRSCREAALMKFRMKRKDRCFEKKVRYHSRKKLAEQRPRVKGQFVSQKLNSATTTDAEADS

SEQ ID NO: 3703 - protein, 1269 aa, Zea mays
MAEGSSSHRRSAFSPGLAVLLSGDEAKISSQKSHLVSYHDEIGHQAVERTIEHIFDLPHKSVVRPPGPIDTGFVHSVVRNQARKFDLDWENCIRGYHRSVFIVDKGAGQRKVVLDDSSICGSFRNVRGPSLVESSAPFSSARANACVWKGKWMYEVTLETSGVQQLGWATLSCPFTDQKGVGDADDSYSFDGRRVTKWNNDPKPYGQPWAVGDVIGCCINLDAGEISFYRNGTSLGVAFDGIRSVEPKKGYYAAVSLSEGERCHLNFGSHPFRYPVDGFDPLEAPPRSWSFVTYLLRCLFRLLEVHNLEKSESAYFEKLRRVKKFAPLQELFGPISEGICAEIFSAIEASQGCLEYIAWGSLITLLLDVFRTREPHDFSCLDQVLDLFLRFPGCTSLFQELIVALSCMCKVAPLVLTECPYSGSYPFLALVCHLLRHKDVMCLWWKAEDFVFSFEGFLTRKIPNKQDLQCLVPSVWWPGSSEDEVSMTLTMTTLSDAIKKIEEMHRELCSLVICFIPPMSTPQPPGSVFRSFVQSLVLKARGGDHRMVVNGTFNNTVLVSLYTVILHLLSEGFSMDSAGSASSSKANFGNGVGFLHKGGKRKFPTQLFFRNDAYHSVIPRIGGPPSILMHHQFDAVENEVQWDEGCMNDEETRVTHTTAQKPCCCSVTDVAVGLRYKETAKYVPSTSKGSCKPMPERSPHVAAECNGRGLSDEIEDKPSTSAQSEIEYGYQSLHSLENMPMATQSSSETLKEEELLDVMLLLYHLGISPNFRQAFYFMSQQSQSISLLEETDRQIREKSCSEQVRRLKEARNSYHEDLVDCVRHCVWYRATLFSQWKQRGMYATCMWVVELLLVLSNSNSMFHYVPEFYVESLVDCFHALRRSDPPFVSPALFLMQGLASFVTLVVKHFDDTRIVNPDLKDLLLQSISVLVQYKEFMLVFENNREAINKMPRSLLSAFDNRSWIPVTNILSRFCKGSGFASYKNGESASSATFQVLLRETCIHEQELFFSFLNRLFNTLSWTMTEFSMSIREMQDKNQVADLQQRKCSVIFDISCSLARILEFCTREIPCAFLMGPDMNLRRLTELVVFILNHIISVADAEFFDMTLRRPGQHQEKTNRTMILAPLVGIILSLMECSSTSERRELNDVIAVFASMDCPATIHFGLQYLLSYNWSNVLRGDSSLAKLAQLKEFSHYFRRITASVDGEEEDHSLNAGDEDDDHTCCICYNCDSDATFQPCHHRSCFGCISRHLLNNQRCFFCNAVVTSVTR

SEQ ID NO: 3704 - protein, 418 aa, Zea mays
MEVCDELRSFEATGVYRLDGTCSGAGATYLDPVRLLNASYQRFRIVPSAYYSRSFGPQHQEGEPEIERPEKRRKRKRNQKPKPRELNPMERIAEARHQEAKPLLLNAHESLVKAKHLLEYISKTIKGNEHTLDAGSGSENNFVELGTSWRAPFYEITLCFQKPHVLGNEEGFFHAQKTSFPLFNSIISVEGTDEAEGEFRNRRYILPRGSCFLMADFKRVRDLIPCSPNQGYNLIVVDPPWENGCVRQKEVYPTLPNKNFLYLPVQQLARPTGALLVLWITNREKLRAFVEKKLLPSWGVEDSTVFYWLKVKPDGSLIGDLDLFHHRPYECFLLGYINGNANAKQGSNFKLLERSQVIMSVPGAHSRKPPLEQLLSEYIPGPKPSRCIELFARELFPRWTSWGNEPLHFQDTMYFSEK

SEQ ID NO: 3705 - protein, 715 aa, Zea mays; identical to SEQ ID NO: 449

SEQ ID NO: 3706 - protein, 972 aa, Zea mays
MRPLALLVLAHLAALAAAAEAKGGVAGAGLGDDVLGLIVFKADVSDPDGRLATWSEDDERPCAWDGVTCDARTGRVSALSLAGFGLSGKLGRGLLRLEALQSLSLARNNLSGDVPADLARLPALQTLDLSANAFAGAVPEGLFGRCRSLRDVSLANNAFSGGIPRDVAACATLASLNLSSNRLDGALPSDIWSLNALRTLDISGNAVTGDLPIGISRMFNLRELNLRGNRLTGSLPDDIGDCPLLRSVDLGSNSLSGNLPESLRRLSTCTYLDLSSNEFTGSVPTWFGEMTSLEMLDLSGNRLSGEIPGSIGGLMSLRELRLSGNGFTGALPESIGGCKSLMHVDVSWNSLTGALPTWVLSSSVQWVSVSQNTLSGDLKMPANASSVLQGVDLSNNAFSGVIPSEISKLQNLQSLNMSWNSMHGSIPASILEMKSLEVLDFTANRLNGCIPASKGGESLKELRLGKNFLTGNIPAQIGNCSALASLDLSHNSLTGVIPETLSNLTNLEIVDLSQNKLTGVLPKQLSNLPHLLQFNVSHNQLSGDLPPGSFFDTIPLSCVSDNPGLCGAKLNSSCPGVLPKPIVLNPNTSSDPISPTELVPDGGRHHKKTILSISALVAIGAAVLIAVGVITITVLNLRVRAPGSHSGAVLELSDGYLSQSPTTDMNAGKLVMFGGGNPEFSASTHALLNKDCELGRGGFGTVYKTTLRDGQPVAIKKLTVSSLVKSQVEFEREVKMLGKLRHRNLVALKGYYWTPSLQLLIYEFVSGGNLHKQLHESSTTNCLPWKERFDIVLGIARSLAHLHRHDIIHYNLKSSNILLDGSGEAKVGDYGLAKLLPMLDRYVLSSKVQSALGYMAPEFACRTVKITEKCDVYGFGVLILEILTGRTPVEYMEDDVVVLCDVVRAALDEGKVEECVDERLCGKFPLEEAVPIMKLGLVCTSQVPSNRPDMGEVVNILELIRCPQDSPETELG

SEQ ID NO: 3707 - protein, 229 aa, Zea mays
MAWRGPLGAGEEALDSGLELSLGLPAYFARPSGLDAAREESGEASAFAIQAASGSNGSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 3708 - protein, 292 aa, Hordeum vulgare
MPPLLLLLLAALAPVLSHAAAGGSYDPARVAQISWRPRAFLYSGFLSHAECDHLVELAKGRLEKSMVADNDSGKSVMSEVRTSSGTFLSKREDEIISGIEKRVAVWTFLPEENAESMQVLHYEVGQKYDAHFDYFSDKKNVKRGGHRVATVLMYLTDVKKGGETVFPVAEGRDLQHKDETWSECARHGLAVKPRKGDALLFFSLHVNATTDPSSLHASCPVVEGEKWSATKWIHVRSFDNPPDVMTDAPCSDANEQCPRWAALGECYKNAKYMVGTKDTLGSCRKSCGVCDA

SEQ ID NO: 3709 - protein, 490 aa, Hordeum vulgare
MEIAGPLAPGERPHAVMIPYPAQGHVTPMLKLAKLLHARGFHVTFVNNEFNHRRLLRSQSADTLRGLPAFRFAAIADGLPPSDREATQDIPALCHATMTTCLPRFKELVLKLNEEAEASGGALPPVTCVVADSIMSFSLRAARELGLRCATLWTGSACGFMSYNHYKDLVDRGIFPLEEEAQLSNGYLETTIDWIPGMPKDMRLRDLPTFLRTTDPDDIMFNFFVHETAAMSQASAVIINTWDELDAPLLDAMSKLLPPIYTVGPLHLTVRNNVPEESPLAGIGSNLWKEQDAPLRWLDGRPPRSVVYVNFGSIAVMSKEHMLEFAWGLANTGYAFLWNVRPDLVKGDDEAALPLEFTTATEGRSMLSTWCPQEKVLEHEAVGVFLTHSGWNSSLEGICGGVPMVCWPFFADQQTNCRYKCTEWGIGMEIGDDVRRTEVEALIREAMEGEKAREMRRRVLELRESAVASARPGGRSMRNVDRLIHEVLLA

SEQ ID NO: 3710 - protein, 545 aa, Hordeum vulgare
MPAAAFASALASPPPPWAPRPSPRHASLRLPPPRSSGGGGDKPTTSWVSPDWLTSLSRSVLGRGNDDSGIPVASAKLDDVQDLLGGALFLPLFKWFREEGPVYRLAAGPRDFVIVSDPAVAKHVLRGYGTRYEKGLVAEVSEFLFGSGFAIAEGALWTVRRRAVVPSLHKRFLSVMVDKVFCKCAERLVEKLETYALSGEPVNMEARFSQMTLDVIGLSLFNYNFDSLTSDSPVIDAVYTALKEAEARSTDLLPYWQIDLLCKIVPRQIKAEKAVNTIRNTVEELIIKCKAIVDAENEQIEGEEYVNEADPSILRFLLASREEVSSLQLRDDLLSMLVAGHETTGSVLTWTIYLLSKDPVALRRAQDEVDRVLQGRLPRYEDVKELKYLMRCINESMRLYPHPPVLIRRALVDDVLPGNYKVKTGQDIMISVYNIHRSPEVWDRADEFIPERFDLEGPIPNESNTDFRFIPFSGGPRKCVGDQFALLEAIVALAIVIQKMDVQLVADQKISMTTGATIHTTNGLYMNVSLRKVEQEADLALSPSG

SEQ ID NO: 3711 - protein, 491 aa, Hordeum vulgare
MKEANQGAGDRESRRTVVMYPAPGAGHLIPTVEFARLLVSHGLAVIVVQRGLPAGNATVPASSLYGNGDASASPFLSFHYIPEPPLPHGMPEGDHVGKVFELSRASNPELRDFLRATAPAALLLDFFCYSAADVAAEIGIPTYFFFLGCTASLAVLLHLPVIHGQNAVNLGDLGGEPVKVPGVTPIPAHDLPAAFLDRSSVSYKHFLAVSQQLCQSHGVIVNSCRSLEPRATDAVAAGLCAPPGRTTPPLFCIGPVVKSEEVAEKQGEECLAWLDTQPEASVVFLCFGSMGRFSAEQIKEMAAGLEMSGQRFLWVVRSPAGGNGNGNEHPGEPELDVLLPDGFLDRTKDRGLVVMSWAPQREVLAHGSVGGFVTHCGWNSVLEAVMAGVPMLGWPLYAEQRMNKVLLVEGMQLGVAVERGEDGFVTAEEIERKVTWLMGSDGGRELRERTLAAMRGAREALSDGGDSRAALLQLVQRLSAPDVTEESVCQL

SEQ ID NO: 3712 - protein, 523 aa, Hordeum vulgare
MTMVALGLCSSFFSVMVMLAVMYVVRRLGSKWTCSSAPGALPPGPCPWPVVGSLPELKFNKLPAFRWIHQVMEKMDTDIACFRLGGVHVIPITCPRIAREVLKKQDEIFASRPETFASCVASGGYVEAALAPFGVQSTKMRRVLTSDIISPSRHKWLHDKRVEEADNISWYMYNLTGGEEGGNVDVRHLSRHYCGNVIRRLLFGTRYFGEAGHGGGPGKLEMEHMDASFAAQGILYSFCVSDYLPSLLGLDLDGHEKIVKDANAVLDRLHDGVIDERWKQWKAGERGEVQDFLDVLITRRDPRLTMEEVKAQAKLINLAAVDNPSNAAEWALAEMVKNPELLGRAAEELDRVVGRERQVQESDIPQLNYVKACIREAFRLHPIAPFNVPHVALADTVVAGYRVPKGSHVLLSRLGLGRNPAIWNDPLRFNPDRHLEGAGGNLELTENKLRFISFSTGRRGCVAPMLGTAMTVMLFGRLLHGFTWSKPAEMPDIQLTESHNDLSMAKPLVLHAKPRLPLHLYRP

SEQ ID NO: 3713 - protein, 536 aa, Hordeum vulgare
MSMQQQQQQPTSANLLGAMPASSMISIAFTAAVGTAVLFVAVAVARYNRKYRGLRLPPGPPVWPIVGNLFQVAFSGKLFIHYIRDLRREYGPILTLRMGVRTLVVISSAELVHEALVEKGPEFASRPAENTTRNIFSSNKFTVNSAVYGAEWRSLRRNMVSGMLSTSRLREFRPARLRAMDRFVARMRADAVASTDEASVWVLRNARFAVFCILLDMTFGLLDLDEEHIVHIDAVLKRVLLAVGVRMDDYLPFLRPFFWRKQRLALAVRREQIDTLLPLIDRRRAILRDMQRSPPDPNVAAPFSYLDSLLDLHIEGREGADDELVTLCAELINGGTDTTATAIEWAMARIVDNPSIQARLHEEIMQQVGDARPIDDKDIETMPYLQAFVKELLRKHPPTYFSLTHAAVKPGSKLAGYDVPTDANLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 3714 - protein, 520 aa, Zea mays
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWAALHLQETAATLLTASLATRNSEPVNSATTVLPAQGGSSTLENPSDLSSQSPDVSGASEVAHSTDLISQVPNSTALYEPLEINEKEGSKSNSDDKTVEKLGSTSTEFDCDLLDISRKSNTVSSADSKGEDITPSAKRKNKDDGSHTSIPLEDTPSTLTNKGVSSQSRVEQDKATSFVSVKSDDIQLSIRMPSGNRLEIKLTKQDVLRKVKNFVDENQGNGLGSYDLSLVYPKRVFSEQDMEATLSELGIQNRHAMIVVPHRQSGQVSRRHSSASYDMGVNSGADDVGGNSGAGGYFGYLRTVLSYVNPLSYLRGNTNSSNTELQSNEGLRQLRHGSGPWSEPRPLGNRGHEVTDADSANTLRRRPRPFGANIHTLGSEDHGPSDERNVFWNGNSTEFGGDDRK

SEQ ID NO: 3715 - protein, 489 aa, Zea mays
MGSLPPVDGQRRPPHVVMIPYPAQGHITPMLQFAKLLHTRGFHVTFVNNEFNHRRHLRARGPNALDGTDGFRFAAIDDGLPLFEADATQDIPALCHSTLTTCLPRFKDLIARINAEAEAEGQPTVTCVVGDSTMTFALRAARELGLRCATLWTASACGFIGYFHYRHLVERGMVPLKNEEQLTDGYLDTIVDWIPGAPKDLRLRDFPSFVRTTDPNDVMLNFFIHETEGMSQASAVVINTFDELDATLLAAMAKLLPPIYTVGPLQLTVRNNVQANSPVAAIGSNLWKEQEAPLRWLNGRAPRSVVYVNFGSITVMSNEQLVEFAWGLANTGYYFLWNVRPDLVKSGDSAGLPPEFSAATEGRSMLSTWCPQAAVLEHDAVGVFLTHSGWNSTLESICGGVPMLCWPFFAEQQTNCRYKCTEWGIGKEIGDDVQRGEVESLIREAMEGEKGQEMLRRVTELRDSAVAAAGPDGRSMRNVDRLIEEVLLA

SEQ ID NO: 3716 - protein, 511 aa, Zea mays
MSGMSDSAGGVRAGAELMVQQFHLKVLHAVLAVRTPRPHAFAAPAAASFRRRDRWFHLPLHDPPPPPEAADRLDDLVPGEPMVVDVLLSPAGSVGARGEVVERWTVACEPWPDAAGGEEVAVNRAYKHCFTLLRSVYAVLRVLPAYRIFRLLCANPSYNYEMGHRVDTFAEPFSRPQEAAMRSQRFVPVETQLGRLVVSVQYLPSLAAFNLEITSLSPSKIIPDYVGSPAAEPMRAFPASLTEATGSGFPPSNQQQRPHSWASPVFWSHTPAHQARFSPPPVFYASPTPSPPHFPPRLMRWESAPMPIPQVSERKSPAHRQNMLPPPSTRRGDMRAAGALESPSESGRLIGRMEELRIADPYVTSSPRHKGKDTKDGSGRFSALSSCDSPRQDDLDDVDYHFDVDDVDTPVSQPRRIDGKETGDQVGSSSHKSQDAQVGSLVNLLRNASPLRNPSNSSQTSRAESSEVASASSVTSRRTSDALEELQSFKEIRERLLFRSSAKHQEPPGKP

SEQ ID NO: 3717 - protein, 360 aa, Zea mays
MVAAAAAAAAATATATATAAALLAPGLKLCAGRARVSSPSGLPLRRVTAMASAPNSSFRPEEARSPPALELPIPPLSKFKVALCQLSVTADKSRNIAHARAAIEKAASDGAKLVVLPEIWNGPYSNDSFPEYAEDIEAGGDAAPSFSMLSEVARSLQITLVGGSIAERSGNNLYNTCCVFGSDGQLKGKHRKIHLFDIDIPGKITFKESKTLTAGQSPTVVDTDVGRIGIGICYDIRFQELAMLYAARGAHLLCYPGAFNMTTGPLHWELLQRARAADNQLFVATCAPARDTSAGYVAWGHSTLVGPFGEVIATTEHEEATIIADIDYSLIEQRRQFLPLQHQRRGDLYQLVDVQRLGSQ

SEQ ID NO: 3718 - protein, 407 aa, Zea mays
MAAVFFHHVVGDLTVGKPEVAELHDTDTLDDAARAIAASPEGAVPVWRPRAAPDDPPSGARFIGMISALDIAAFVASAGVGDRSMRAVVGEVVQPNPALLREIDPGTRLIDALELMRHGVKRFLVRKSGSWKGITKRFSVLYNGKWLKNMESTSPSAASSSSTQLSPRSGSAEKFCCLSREDVLRFLIGCLGALAPIPLTQISSLGAINPQYSYVEASAPAMEAIQKIPQDPCAVAVVETMPDGTRNILGDISTYKLWKCDYVSAAWALANLSAGQFVIGADENGSTPISVFPEPPISPSSPVEEISPGRSPRAKKFSSRSIGFLNNTQMSAWRTRSMYHRGRSTPLMCKTTSTLAAVMAQMLSHRATHVWVTDAESEEDGVVVGVVGYTEIFNAATRSTCPSPTAS

SEQ ID NO: 3719 - protein, 239 aa, Zea mays
MGCEEEERLLFPSFVFPESFAEAATPGSGGEQKKARQRRRRKPRPAEGGEGADEQARKRRLSDDQARFLELSFRKERKLETPRKVQLAAELGLDAKQVAVWFQNRRARHKSKLMEEEFSKLRAAHDAVVLHNCHLETELLKMKDRLAEVEEEKTKLVAAAAAAAGGGAGAGSSSPSSSSFSTVTHHPAAALQVGQFGVEPEEAADLAYMTEYAYNSYMNMMDLAPGYFGGVVYDYDHFN

SEQ ID NO: 3720 - protein, 427 aa, Zea mays
MAAADSSPLHIVIFPWLAFGHLIPGLEFAERLAEHGQRVSFVSTQGILRRLRPVAPALASLIDLVALPFPRIDGLPDGAEATSDLPPGTAELHVQAMDRLAPAFSAFLGAACADGSDRKVDWVLLDNFHASMADVASEHKVPCILNMPYSAATTEDFGIPDASVLPMFRPFVETFKRCKVIAARSSFELEPESLPLMTKILGKPVIPVGLLPPAPAGGNTQRDDSAALSWLDEQPSKSVVYVAFGSEYPMTVKQLHEIARGLELAGTRFLWALKRPSVAHPDEDLLPPGFEERTRGRGSVVTGWVPQTSILGHGAVAAFMMHCGWGSTIEALQYGHPLVMMPVLVDHLSTARVMEQRKVGVKVRKEKSDEAFLGDNIATAIRAVMCEEESKRIFVANAKRMQEIVADDECHKRYIDEFVQSLRTYKN

SEQ ID NO: 3721 - protein, 482 aa, Zea mays
MAPPPAMQSPGELNDGAYDAPHILFIPSAGIGHLTPVFRVIAGFSSRGIDVSVVTVLPTVSAAETDYFNGLFADYPAVRRVDMHLLPLDASEFTREDPFFLRWEALRRSVHLLRPIITDAAPRITAIITDITLTSCVIPIAKELDVPCHVLFPTAATMLSLNAYYPVYLEKLKGGPEPGVIGDAVDIPGVFRVPRSALPPALLDVNKLFTKQFIDNGRAIVKADGVLVNTFDAVEPAPLAALRGGKIVPGYPPVYTIGPLKSHATKAGDKPGDALLDEWLGKQRARSVVYVAFGNRSAARLDQIREIAAGLEDSGYPFLWVLKTTKVDREDDAELAEVLGNGYLERVKGRGIVTKGWVEQEELLKHPAVGMFVSHGGWNSALEASSAGVPLLVWPQLGDHRVNAMAAVRAGIGAWAEHWSWDGEDTLVTRQEIADKVKEVMADEKLRAGVAVAREEAAKAVAEGGTSYRNMHDFIAKLKGGA

SEQ ID NO: 3722 - protein, 510 aa, Zea mays
MGIVRVADDVEARLVVGAGGGGGAATTTTEPLLRHCHGGRKEEDDQGSKIRDSPEAEGASDCGRTDGGSLRMVLVSTAVAVCGSFEFGTCVGYSAPTQSGIVEEVGLSISEFAIFGSVLTIGAMVGAVTSGRLADFLGRKMTMRISATICIFGWLSIHLAKSAIMLYFGRTLLGFSTGVLSYVVPVFIAEIAPKNLRGGLATSNQLLICSGSSATYIIGALVAWRNLVLVGLVPCVLLLAGLFFIPESPRWLANVGREKEFHASLQKLRGEYADVSEEAIEIKEYIESLYSLPKARIRDLFLSKNIYAVIVGVGLMVFQQLGGINGVGFYASYIFSSAGFSGKLGTILIGIIQIPITLFGAILMDRSGRRVLLMVSASGTFLGCFLTGVSFYLKAQGLFSEWVPTLALSGILVYIGAYSIGMGPVPWVVMSEIFSINMKATGGSLVTLVSWLGSFAISYSFSFLMDWSSAGTFFMFSSASLITVLFVAMLVPETKGRTLEEIQDSLNTRR

SEQ ID NO: 3723 - protein, 588 aa, Zea mays
MVLARVLPLPAPSSAPHRRLLLPTQASPAPARVPTVRAVACRAANAMAAVALDPPAVAPSPAEVAAVGVGEELPEGYDQMMPTVEPSRRRRAGLLLHPTSLRGPHGIGDLGDEALAFLHWLRDAGCTLWQVLPLVPPGRTAGEDGSPYSGQDANCGNTLLLSLEELVKDGLLMSDELPDPVDTEYVEFDTVANLKEPLIAKAAERLLLSHGELRTQYDCFKKNPNISGWLEDAALFAAIDKSINAFSWYEWPEPLKNRHLGALEDIYEKQKDFIETFMAQQFLFQRQWQRIRKYAQKLGISIMGDMPIYVGYHSADVWANRKSFLLDKNGFPTFVSGVPPDAFSETGQLWNSPLYDWKAMEADGFSWWIKRIKRALDLYDEFRIDHFRGLAGFWAVPSDAKVALVGSWRAGPRNSFFDTLFKAVGRIDIIAEDLGVITEDVVQLRKSIGAPGMAVLQFAFGGGSDNPHLPHNHEIDQVVYTGTHDNDTVLGWWQNLPEEEKKIVIKYLPEAENIDISWTLITAALSSVARTSVVTMQDILGLDSSARMNTPATQKGNWRWRIPSSVGFDSLSPEAAKLKELLALYNRQ

SEQ ID NO: 3724 - protein, 486 aa, Zea mays
MGKLQERKPPACTTAARPRVLLLCSPCMGHLIPFAELARRLVADHGLSTTLLFASATSPPSEQYLAVAAAVPDAVDLVALPAPPPDALPPATAARERAELAVASNVPRVREIARELGAAAPLVALVVDMVGAAAAAAARDVAAELGVPFYAFFTSPWMTLSLLLHLPEIDATRAGEHRDAAEPIRLPGCVPIHAHELPTSMLADRSSSAYAGFLSMAKGVAGVDGVLVNTFRELEPAVGGDGGLELPVYPVGPLVWTRPAGVDTDHECMCWLDGQPRGSVAYVSFGSGGTLTWQQTAELALGLELSQCRFIWAIKRPHQSSTIAAFFGTQRGDEHSPLDFLPEGFMERTRGVGLVTQSWAPQTAILGHPSIGCFVTHCGWNSVLESVINGVPMVAWPLYAEQNMNAAMMEVQVGVALRAKVGADRFIRKDEVANAIRRAIVGEEAERLRKRSSELRRQSAQALSKDGCSTRALAQIANAWKRASRK

SEQ ID NO: 3725 - protein, 302 aa, Oryza sativa
MDGGGGMLGAVLCLLLVFAIFPLLLWRRRSDAAHRLPPQPLQDERVLRGGPAPGPAARRMRRRPLSTSADASTSRDRDVDDADSDLEEEIQDVPRGSKKKEKKRQDREAQRQAEEAARDSRRTKQDRYAEMRRKKDEEREAQERLMEEEARARKAKEEEAAALEFEKWKGAFSVDAEGTTESDTQDDGQGLLHNFVEYIKNQKCVPLEDLAAEFRMRTQDCINRIITLEGMDRLSGVMDDRGKFIYISTEEMKAVADYIRKQGRVSISHLASNSNQFIDLEPKPQYNEESNLDENAAAGTEL

SEQ ID NO: 3726 - protein, 412 aa, Oryza sativa
MASTKIKVANPIVEMDGDEMTRVFWKSIKDKLIFPFLELDIKYFDLGLPYRDQTDDKVTVEAAEATLKYNVAIKCATITPDEARVKEFSLKSMWKSPNGTIRNILNGTVFREPIICKNIPRLVPGWTKPICIRRHAFGDQYRATDAVIKGPGKLKLVYEGKDEEIELEVFNFTGAGGVAQSMYNTDESIRSFAEASMATAYEKKWPLYLSTKNTILKKYDGRFKDIFQEVYEAQWKSKFEAAGIWYEHRLIDDMVAYALKSEGGYVWACKNYDGDVQSDFLAQGFGSLGLMTSVLVCPDGKTIEAEAAHGTVTRHYRVRQKGGETSTNSIASIFAWTRGLAHRAKLDDNARLLDFTQKLEAACIGAVESGKMTKDLALLVHGSSNVTRSHYLNTEEFIDAVADELRSRLAAN

SEQ ID NO: 3727 - protein, 711 aa, Oryza sativa
MENGDKDEKNVAVTEGSTNSEEKDQDEDLLRRTEMLNAKEAINSSNENSGNDSEAQIHVRDDSQKEFNEKMNKEGSSDPMEPTDSSQTEEDILAEDKSEEPVFDGTEVAEMEDLRRSSNQSVELDSDAHGSVLNERATAIKNFVKEKGAIAVSTFIRRLSGKKDENEFSVEDEKNEGSESISSGNIGSDAEPKSKEVQPKSEERTTWNPLNLIKIGRDFDTFMTGEAGHENVPDLIEQPTGKGRIIIYTKLGCEDCKMVRSFMRQKMLKYVEINIDIFPSRKMELENNTGSSTVPKVYFNDLLIGGLTELKKMEESGILDDRTDALFKDEPSSAAPLPPLPGEDDESGSGKIDELATIVRKMRESITLKDRFYKMRRFSSCFLGSEAVDFLSEDQYLERDEAVEFGRKLASKYFYRHVLDEDVFEDGNHLYRFLDNDPIIMSQCYNIPKGIIDVEPKPIVEVASRLRKLSETMFEAYVSEDGKHVDYRSIQGCEEFKRYVRTTEELQRVETHELSREEKLAFFINLYNMMAIHALVTCGHPAGPLDRRKFFGDFKYVIGGCAYSMSAIQNGILRGNQRPPYNLAKPFGQKDQRSKVALPYAEPLVHFALVCGTKSGPALRCYSPGNIDKELVEAARDFLRNGGIVVDPEAKVASVSKILRWYSTDFGKNETEVLKHAANYLEPAESEQFLELLANTQLKVLYQPYDWSLNI

SEQ ID NO: 3728 - protein, 542 aa, Oryza sativa
MAMEAEALLPEPEPESPPLLAVDHLGGPASRGSSGRWPAAFFLIGAEVGERFAYSGIMGNLVIYLTGPLRQPTAAAAAAVNVWMGTSMLLPLLGSAVADSWLGRYRTIVCASLLYILGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSKLPDSSDELLPSSSSEGDVSNSSSEFVPNEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKVISVQ

SEQ ID NO: 3729 - protein, 354 aa, Oryza sativa
MATDGDALESQAAAAAEAARELREAAASLVARRSADEDALRRRATALDADLRRLQASLSTLAPTTLDKVEEELERARVTISDSDVAAFLPSKRNGKFLKTFVGPVNVRVARKEDKLRVKDEYNNYRDRAAYMFLLFPSILLLLRWWIWDGCLPALAVQMYQAWLLFLYTSFALRENLLIVNGSDIRPWWIYHHYLAMLMALVSLTWEIKGQPDCSSKQRGVQLFLRWAIMQGIAMHLQNRYQRQRLRTRIALGKAKRMDVVAGETAGVEGQLLLLYPVLFTLQVFEGYVGVLLLKTALHGLASEWQVVVCGILLVVMAVGNFVNTMETLMLKLRFKAKMKRAKSRQDLSRQHQN

SEQ ID NO: 3730 - protein, 1146 aa, Oryza sativa
MASSAEPPPKKRRLVEVHVPSPAPSPSSSSAPAPASPRSPVPPPPGVPPPPPPPPQTLAAAASPRPEEAVRKRRNREELRGLFECYRRIRLCVERKDARLLPELEQVYLSLIASSRGCTSVQRILADLIPQYASYCPTALEAATKVSINMYKWNLAIVTRGEDVDGVAYQTARACILGLTDICSTASCEAPKSSVLTGICSAVYITVLTFFISTFDGKDIYHIGSRKLLNLQDPVELLDILKQDSGGDNQQADDCLVELRALSLLCIFLLFPENILDACFALIASAEDVNGEGLYFLKQLTCHLNSGIITDALDVQGDGVSQCTGMDVDHPSTKESVDSNLSSHSVGVSGSSMLQPNECYMTMAISRHPSLKGWILLRYKKLCDSCRTDVVSEVSSCLNVLGSLTQLEDNKSHMGSESSVLDKIDENSGGYLQPNKLACSYEQRMLLKTDIADRYGGKTVQNKNAQMVHTDEVKTEKLADVKLDVCKQGNVISDAGHQAARLDMHTPKSTHDSAGGAATLTSPGQNFGKAKHSYSEPSDLYGAHFSRDVISVSKELWIGSLGNSAAESLVRSKFEEFGPLANFLFYPPKNFALVEYGNIMHAVHAYGCMQGSSVWGGGLQIRYLDRLIGSKGFASGIAVGESRHIYVAKVKNKKDKDEVFDELKAAGLKRPCSFTDISSENALLLEFDTATDAAAAKAHIRRQLHPDVCSQDKNTSGHELFVRNIDNSVPDMEFINAFSRFGEVIRWQFNKLDGNCLIDYRSPNAAATAKSHLHGARFGLKSISVESRSVHDKTLSPSVPMLAPSVSDSSHHEIRNPRVSGYNAGFTVPTERPIYGPSAPRAPQGILPCPPVSAHRGPVIPPPPIQTSFVRPVYPGPGSPWENTTPNPSFSHASPRMMPGSSFRMNPPAPLPFIPSSVTPLTQFPGGSAQQSEKRPPPPPPPPNVAPPPFTRQDIPPPPPSPPPLPITQPPSVPPPPNSPPPLQPATDPSDSQKQRSHPRWQGSLSKSGLHYCSIYASRIELDACRYEHAVSEPTGWPSRLDVTKRTDYQHVKTTFSNTPPSKREVCRLLPCSNGDQKGFRDFISYLKQRECAGVIKIPSVKPLWSRLLFILPPTPEACGMLELPPHPTECLIALILPKETTAEAT

SEQ ID NO: 3731 - protein, 232 aa, Oryza sativa
MAPGLQRFTDIAGDGGPRLDAASGEELLRMDRAASVALGRRAPEPPGTLFVTTRRVIWLSETEKGQGYAVDFLAITLHAVSRDLEAYPSPCIYTQIDAEDGSDEEAGGSDFEANGDLQLTKVSEMRIILSDPGQLDALFDVFCHCAELNPDPNAVRNEENGWSGGENMAEGGWIHGDEDMIDGNDLEAHMFFTNLIGQNGVHDLGRSVRELQIDDQRFEDAEEEDEIQENGH

SEQ ID NO: 3732 - protein, 330 aa, Oryza sativa
MARGVARAASFGGRAATARWCSYRRITVAVCLGNLVAALLVLRSLTSLAPTPPKRQEVVEYTEEQIRKAEESIRIRREAEPVELVEAVKNLRKIFRREEKRRKELPLELKQKVSYEIVQLLLDLGDNSSFAQQREAVESWRFEKLKDIKSASIQNSTKLDLSNEEARTLKRALQFNWHVLLEDIGLWIPSEVSHTEHDDKPENEPEEEEIIAGPPLPSQCNAELHTDYDGAAVRWGLTHPKESAADCCQACLDQAKNARPGELRCNIWVYCPSEFGCFSPDKYEHKHQECWLKQADHPKLNFKDKYSESYRDSHPTAPVVVPWMSGVISA

SEQ ID NO: 3733 - protein, 374 aa, Hordeum vulgare
MAKEGGPDWNGLLKWSLAHGADGTNPPRALSEEDRKWFMEAMQANTIDVVGRMKEIAQVMKTPDDVLQSHGVTPGNIEDMLDELQEHVESIDNANDLHSIGGLDPLLGYLKNSHAGIRAKAAEVVSTVVQNNPKSQQLVMESNGLEPLLTNFRSDPSTTARTKALGAISSLIRNNQPGLAAFRLGNGHAALKDALGSDDARLQRKALHLTQYLLNNKADRSVAEEIGLPNQLIHLASSEDSGVREAALGGLLELARDKAPVARNALPDQDKLKDVLRSRIEGISTMDADDLQAAREERQLVDSLWKECYGEPSSLREKGLVVLPGEDEPQQPPPDVAGKMFEPPLRAWAAPRPSSAEDSDSASGKKDPPLLLGP

SEQ ID NO: 3734 - protein, 142 aa, Oryza sativa
MENGGEEDDRASRCKRITRESDATKNGAATKLQALRLVEDLSLPSVQVVVMSANMGCSHCRQRVTKVVSKMNAGLLDYMVDFGKKEVTVRGTMVHTKKKRKQHKKKHEENKKGIAANWEKKSSSQSNDSARTLAWFLRCYSS

SEQ ID NO: 3735 - protein, 492 aa, Oryza sativa
MNAGFSPQILAQKLLKLNNSRQSIETLSHWCVFHYRHCRQVVETWESDFHSAPRERRVSLLYLANDIVQNSKKDSGRYVNEFWRVIPAALNDVFVNGDDFGRNVVQRLVDIWEERNIFGSHGQSLKEDYSRRFKEFKSKSRNSSGELLEKVISCYKHMLNAHVDDDTLMRKCQNALSFVDNLSNEYENNSILDCSNGSGFVEELQEQHNVLRDSIEQFKTSELLRGNLISCLKEALHEQEFKMERARSQIKEVQSRYKKADDLCQKLGIHVERQEQPNHGPKNSGSEMHGSFGPGPDSANASSFEKGQSSAVMYSQENGGEHEIPNGVFSSRATKDNIEQKLEEHSTNKRQKLQNDVYVSRPQSPPPPLPSDAFEQPPPPPEHPPPPESTSPPPPPTSDPPPVPPPPPTTGSFMPIPSAPFAGLPVPAGPMTAVPYNSYPVFPPMNYPMVNIPPPFPSAPNTPPGFQGLAGPFYGPPFPAPPPPPPPPMNRK

SEQ ID NO: 3736 - protein, 86 aa, Hordeum vulgare
MAKCLAAALLLLVVLAYCDGRELNQKDQALATARGAGAGAGAGGGVGEEKILGLPELPLVGTVTGTSTVTGPVVVLPALPGIPAHP

SEQ ID NO: 3737 - protein, 366 aa, Oryza sativa
MEDNLPVNVREYQELAKKALPKMAYDYINGGAEDEHTLRENIAAYTRIILRPRVLVDVSKIDMSTTLLGYTMRSPIIVAPTGGHKLAHPEGEKATARAAASCNAIMVLSFSSSCKIEDVASSCNAIRFYQLYVYKNRNVSATLVRRAESCGFKALLLTVDTPMLGRREADIRNKMVFPRSGNLEGLMTIDDHDTTNGSQLERFARATLDPSLSWKDIEWLKSITSMPIFLKGIVTAEDARRAVEAGVAGVIVSNHGARQLDYAPATIAALEEVVRAVAGAVPVLVDGGIRRGTDVFKALALGARAVMVGRPVFFGLAARGEAGARHVIEMLNGELEVAMALCGCRSVGEITRSHVMTEGDRIRSLL

SEQ ID NO: 3738 - DNA, 2531 bp, Oryza sativa
tactaacaaacagataatctccacgcctcggcaactccgctccccactgccatggccggcagcggcggcggcgaccgcggctcgcccgaggcggagctccggcgcgggttcaagacgctcgccgtgacgcggcccgacccgtccgcggcggtctacgaggtccgcctcaaccgccccacccggctcaacgccctcagcccggacgccttcgcggagatcccgcgcgccatggcgctcctcgaccgcgcccccgccgcgcgcgccgtcgtgctctccgccgccggcccgcacttctgcgccggcatcgagctcggctcccccgggagccccgccacggccccctccggcgaccccgcgcccgcggccgccgaggggctccgccgcgccatcctggagatgcaggcggcgctcacggccatcgagcggtgccggaagccggtggtcgcggcggtgcacggcgcctgcgtcggcggcggcgtcgaggtcgtggccgcctgcgacatacggtgctgctccaaggacgccacgttcgtgctcagggaggtggacatggccatcgtcgccgacctcggcgcgctgcagcggcttccgcggatcgtcgggtacgggaacgccgccgacctcgcgctcaccggccgcaagatcaccgccatggaggccaaggagatggggctcgtgaccagggtgttcaattccaagcaagaattggatgctggcgttgcaaagattgcaaaaggtacacagttcgatcttcttgtattttttttaccatataaataaatatatatctatgttcttagctagtactccctcatttcaaaatgttgactttttagcgtttgatcgatcgtcttattcaaaaaatttaagtaattattaattcttttcctatcatttgattcattgttaaatatatttttatgtaggcatataattttatatatttcacaaaagtttttgaataagacgaacggctaaacatgtgctaaaaagtcaacggtgtcaaacgtttcgaaacggagtattattgtagctgttgctacctactactccattaaactgtggaatcagaatattttatcttcattcagaattgacaatgaaatgaaccgtgtgtaactgtagaatcatgttatctcttggattaatgttggactgtatatcgtttttcattcaacaaattcagcctatgcaggctctaattgatgtaactggataggtcattcaggactacttttggaagtataccttgttcagtttacttttagtggaggcattacatctttcattactgaataaaaccacaagtatcaccaagggaaataatgataacagggatgaatcacattgcttacagttgccgacttgcttgtattcaacggtagcaactttccaggactaataagtaataatgccttcaacatccatatatataatattcatttatcttgaattacaaatagtggtggtcttatggttataccagattatactctagattagatcgatccaattcatgcatgacacattacactctgtaatggttggggagacacactggtccattttccactgtaacagggggtggattgcaaagctttggagggtgtcttaaacttttagggaaaagcccattcctgattagatgtctttctttgttctcggtcctattgttactgtaggctggtttttttaagaactcgaattcatcagaaacgtgagctgtgtcttctcctccatcctttttagaaaagaatacaaagagaagcttattctgcccatctatggagagaatgaaactaaacgctctaccaacctgcctaaaagatctggagaatgaagaactgcatagacaatatgctaactaaccactaccacttcaattgaatgacagacttcatctctccttaaagtcagatcacttaatgactttctgctcctgttttgaccctgtgaataatcagctgtgatgttttgagggaatatgtattcaatattatatctctgtcaattgaagaagttcgatttatccttaacatgattgcaaatattgttatatggatataattgtttcttgtttaacatgcacatcacattttgtttttgctgctaaactcaacaagcttggcttatgctaaatatagtgttggatatgattaaccatttcagaaatatctgagaagtcagcatgggcagtgatgggaacaaaggctgttttgctgagaagcagggatataacagtagagcagggcctggagcatgttgcaacatggaacgccgcaatgctgagatctaatgacctggaggaggctatccaagccttcctagagaagcggaagccagtcttctccaaactgtaatgatcatacaccatacttgacagaagaaagttatatttgaatcctagtacttcagaataagggaaaggctataaatctatgattgcagttggcaaatatgtgaagagcttacacttagtacagtggaccagaaatgcttccaatcaatgcatcaaagatctccaacatgtt

SEQ ID NO: 3739 - DNA, 2531 bp, Oryza sativa; identical to SEQ ID NO: 3738

SEQ ID NO: 3740 - DNA, 30 bp, Artificial Sequence
  Single strand DNA oligonucleotide
aaagtcgacagtaggcaatcatgtgtgagg

SEQ ID NO: 3741 - DNA, 34 bp, Artificial Sequence
  Single strand DNA oligonucleotide
aattctagactaagctagagagctcgactaatgc

SEQ ID NO: 3742 - DNA, 27 bp, Artificial Sequence
  Single strand DNA oligonucleotide
atactcgagtctccaaccttgcgaagg

SEQ ID NO: 3743 - DNA, 27 bp, Artificial Sequence
  Single strand DNA oligonucleotide
atactcgagaacccgatctctccaacc

SEQ ID NO: 3744 - DNA, 29 bp, Artificial Sequence
  Single strand DNA oligonucleotide
tatggtacccctgcgaattcttgccttag

SEQ ID NO: 3745 - DNA, 27 bp, Artificial Sequence
  Single strand DNA oligonucleotide
tatggtacctgacgccaccctcaactc

SEQ ID NO: 3746 - DNA, 31 bp, Artificial Sequence
  Single strand DNA oligonucleotide
aaagtcgacaggaaaccctaacgaagatacc

SEQ ID NO: 3747 - DNA, 31 bp, Artificial Sequence
  Single strand DNA oligonucleotide
aaagtcgacggaaacatacaggtcgattgag

SEQ ID NO: 3748 - DNA, 31 bp, Artificial Sequence
  Single strand DNA oligonucleotide
aaatctagagggaaagtttagtagcaccaac

SEQ ID NO: 3749 - DNA, 31 bp, Artificial Sequence
  Single strand DNA oligonucleotide
aaatctagaatataacgttagagcggagtgg

SEQ ID NO: 3750 - DNA, 31 bp, Artificial Sequence
  Single strand DNA oligonucleotide
aaaggatccgagctgctgattgtgagtcaag

SEQ ID NO: 3751 - DNA, 34 bp, Artificial Sequence
  Single strand DNA oligonucleotide
aaactcgagctaggacagcacttcagataagacc

SEQ ID NO: 3752 - DNA, 28 bp, Artificial Sequence
  Single strand DNA oligonucleotide
aaaggatcccgaccgagtcaatcaatcc

SEQ ID NO: 3753 - DNA, 31 bp, Artificial Sequence
  Single strand DNA oligonucleotide
aaactcgagaacaagtatgacaggccaactc

SEQ ID NO: 3754 - DNA, 31 bp, Artificial Sequence
  Single strand DNA oligonucleotide
aaaggatcctagctagcttactccacagtgc

SEQ ID NO: 3755 - DNA, 29 bp, Artificial Sequence
  Single strand DNA oligonucleotide
aaaggatccagccacacgcttagcttagc

SEQ ID NO: 3756 - DNA, 31 bp, Artificial Sequence
  Single strand DNA oligonucleotide
aaactcgagcgagcagaaattaacagctaac

SEQ ID NO: 3757 - DNA, 31 bp, Artificial Sequence
  Single strand DNA oligonucleotide
aaactcgagactacagatccaaagcacgaac

SEQ ID NO: 3758 - DNA, 31 bp, Artificial Sequence
  Single strand DNA oligonucleotide
aaagtcgacactcaacgtagttcctcacctg

SEQ ID NO: 3759 - DNA, 32 bp, Artificial Sequence
  Single strand DNA oligonucleotide
aaatctagaaagctttagttctagcacacgac

SEQ ID NO: 3760 - DNA, 32 bp, Artificial Sequence
  Single strand DNA oligonucleotide
aaaggatccgtactcctatattaggctcgctc

SEQ ID NO: 3761 - DNA, 32 bp, Artificial Sequence
  Single strand DNA oligonucleotide
aaaggatccctgcgtactcctatattaggctc

SEQ ID NO: 3762 - DNA, 31 bp, Artificial Sequence
  Single strand DNA oligonucleotide
aaactcgagaatttggtatcagaaaccttgc

SEQ ID NO: 3763 - DNA, 31 bp, Artificial Sequence
  Single strand DNA oligonucleotide
aatctcgagtgaatcactcagtgtgcatgac

SEQ ID NO: 3764 - DNA, 29 bp, Artificial Sequence
  Single strand DNA oligonucleotide
aaactcgagcccagcggactcctactctg

SEQ ID NO: 3765 - DNA, 34 bp, Artificial Sequence
  Single strand DNA oligonucleotide
tttaggccttcacagtcttacaagtccgattgcc

SEQ ID NO: 3766 - DNA, 29 bp, Artificial Sequence
  Single strand DNA oligonucleotide
aaaggatccgaaccaaacctcggagaaac

SEQ ID NO: 3767 - DNA, 33 bp, Artificial Sequence
  Single strand DNA oligonucleotide
aaactcgagaccatcacctgtaatacaactacc

SEQ ID NO: 3768 - DNA, 31 bp, Artificial Sequence
  Single strand DNA oligonucleotide
aaactcgaggaatctggttgctcatctcatc

SEQ ID NO: 3769 - DNA, 28 bp, Artificial Sequence
  Single strand DNA oligonucleotide
aaactcgagcttcacaacggacgagagg

SEQ ID NO: 3770 - DNA, 31 bp, Artificial Sequence
  Single strand DNA oligonucleotide
aaagagctcataatcgttggaacttggaatc

SEQ ID NO: 3771 - DNA, 31 bp, Artificial Sequence
  Single strand DNA oligonucleotide
aaagagctcacagcttatccctacatgcttc

SEQ ID NO: 3772 - DNA, 31 bp, Artificial Sequence
  Single strand DNA oligonucleotide
aaaggatcctcaattgaatcagatgctccac

SEQ ID NO: 3773 - DNA, 30 bp, Artificial Sequence
  Single strand DNA oligonucleotide
aaaggatccattcctttgaccgatttcttg

SEQ ID NO: 3774 - DNA, 34 bp, Artificial Sequence
  Single strand DNA oligonucleotide
aaactcgagctaattaagacaaatcagtggcacc

SEQ ID NO: 3775 - DNA, 31 bp, Artificial Sequence
  Single strand DNA oligonucleotide
aaactcgagacagaaggtcgatgttgatctg

SEQ ID NO: 3776 - DNA, 31 bp, Artificial Sequence
  Single strand DNA oligonucleotide
aaagtcgacttcttgatctaaatttgggtgg

SEQ ID NO: 3777 - DNA, 30 bp, Artificial Sequence
  Single strand DNA oligonucleotide
aaagtcgacactagctctgcactttccctg

SEQ ID NO: 3778 - DNA, 30 bp, Artificial Sequence
  Single strand DNA oligonucleotide
aaatctagagattcaagtgcgttgtctgtc

SEQ ID NO: 3779 - DNA, 31 bp, Artificial Sequence
  Single strand DNA oligonucleotide
aaatctagacttggtatttacaggacaatcg

SEQ ID NO: 3780 - DNA, 28 bp, Artificial Sequence
  Single strand DNA oligonucleotide
aaaggatcctcgccgcagatggaagtct

SEQ ID NO: 3781 - DNA, 29 bp, Artificial Sequence
  Single strand DNA oligonucleotide
tttctcgagcaaactcgtctggagatggg

SEQ ID NO: 3782 - DNA, 27 bp, Artificial Sequence
  Single strand DNA oligonucleotide
aaagtcgacttggctccggatatcgca

SEQ ID NO: 3783 - DNA, 31 bp, Artificial Sequence
  Single strand DNA oligonucleotide
aaatctagaaggcagatgttcataaccacac

SEQ ID NO: 3784 - DNA, 26 bp, Artificial Sequence
  Single strand DNA oligonucleotide
aaaggatcccgtcgtcaagtgctggc

SEQ ID NO: 3785 - DNA, 32 bp, Artificial Sequence
  Single strand DNA oligonucleotide
agtgatatctcaatgtttagggtctcggcatg

SEQ ID NO: 3786 - DNA, 28 bp, Artificial Sequence
  Single strand DNA oligonucleotide
aaagtcgacatcgagttgttcgtccgtc

SEQ ID NO: 3787 - DNA, 31 bp, Artificial Sequence
  Single strand DNA oligonucleotide
aaatctagaacaccaagcgtacatctcagac

SEQ ID NO: 3788 - DNA, 31 bp, Artificial Sequence
  Single strand DNA oligonucleotide
ttactcgagtgcttctcttctttcctctctg

SEQ ID NO: 3789 - DNA, 32 bp, Artificial Sequence
  Single strand DNA oligonucleotide
ataggtacctcacagcaaactaacatgaaccg

SEQ ID NO: 3790 - DNA, 28 bp, Artificial Sequence
  Single strand DNA oligonucleotide
aaaggatccggaagtccggagttggaag

SEQ ID NO: 3791 - DNA, 31 bp, Artificial Sequence
  Single strand DNA oligonucleotide
aaactcgagcagtcactcacacgctactacg

SEQ ID NO: 3792 - DNA, 31 bp, Artificial Sequence
  Single strand DNA oligonucleotide
aaaggatccactgctgaccaacttcagtgtc

SEQ ID NO: 3793 - DNA, 31 bp, Artificial Sequence
  Single strand DNA oligonucleotide
aaaggatccgacaaggctatcacatccaatc

SEQ ID NO: 3794 - DNA, 31 bp, Artificial Sequence
  Single strand DNA oligonucleotide
aaactcgagttctaaagaaacaatcacgcac

SEQ ID NO: 3795 - DNA, 31 bp, Artificial Sequence
  Single strand DNA oligonucleotide
aaactcgagagcagaagaaactaggcatgtg

SEQ ID NO: 3796 - DNA, 28 bp, Artificial Sequence
  Single strand DNA oligonucleotide
aaaggatcctgcagccctgacacacaac

SEQ ID NO: 3797 - DNA, 31 bp, Artificial Sequence
  Single strand DNA oligonucleotide
aaactcgagaccatcatgtaatacccacctc

SEQ ID NO: 3798 - DNA, 31 bp, Artificial Sequence
  Single strand DNA oligonucleotide
aaaggatccctgtgcttggagtagacacgag

SEQ ID NO: 3799 - DNA, 30 bp, Artificial Sequence
  Single strand DNA oligonucleotide
aaaggtaccggagaatttggatcagtgcag

SEQ ID NO: 3800 - DNA, 30 bp, Artificial Sequence
  Single strand DNA oligonucleotide
tttggatcccttcttgctgtcgaacaccag

SEQ ID NO: 3801 - DNA, 35 bp, Artificial Sequence
  Single strand DNA oligonucleotide
tttctcgaggtcatgggattcttgtcagatactag

SEQ ID NO: 3802 - DNA, 27 bp, Artificial Sequence
  Single strand DNA oligonucleotide
tttggatccttcacacctcaccgagcg

SEQ ID NO: 3803 - DNA, 28 bp, Artificial Sequence
  Single strand DNA oligonucleotide
aaaggatccaacccgttcacacctcacc

SEQ ID NO: 3804 - DNA, 31 bp, Artificial Sequence
  Single strand DNA oligonucleotide
aaactcgaggatcacttgacaattaccgtgc

SEQ ID NO: 3805 - DNA, 31 bp, Artificial Sequence
  Single strand DNA oligonucleotide
aaactcgagtatgctgatatgccaggtttac

SEQ ID NO: 3806 - DNA, 31 bp, Artificial Sequence
  Single strand DNA oligonucleotide
aaagtcgacattcagtcttgtcggctacatc

SEQ ID NO: 3807 - DNA, 31 bp, Artificial Sequence
  Single strand DNA oligonucleotide
aaagtcgactagatcagcctcgattcatctc

SEQ ID NO: 3808 - DNA, 31 bp, Artificial Sequence
  Single strand DNA oligonucleotide
aaatctagagcttaatcagaagaaacgaacc

SEQ ID NO: 3809 - DNA, 31 bp, Artificial Sequence
  Single strand DNA oligonucleotide
aaatctagaaattgcacaatacatgaacacg

SEQ ID NO: 3810 - DNA, 28 bp, Artificial Sequence
  Single strand DNA oligonucleotide
aaagtcgaccaagcggtaggagatgagg

SEQ ID NO: 3811 - DNA, 33 bp, Artificial Sequence
  Single strand DNA oligonucleotide
aaaggatccttataacaactattcccggtaagc

SEQ ID NO: 3812 - DNA, 30 bp, Artificial Sequence
  Single strand DNA oligonucleotide
aaagtcgacagaaattaagttgccggagag

SEQ ID NO: 3813 - DNA, 31 bp, Artificial Sequence
  Single strand DNA oligonucleotide
aaatctagaatgcagatgagagctcaagatg

SEQ ID NO: 3814 - DNA, 30 bp, Artificial Sequence
  Single strand DNA oligonucleotide
aaagtcgactccctaccctagtcgatctcc

SEQ ID NO: 3815 - DNA, 29 bp, Artificial Sequence
  Single strand DNA oligonucleotide
aaagtcgacgactcgtctcctcgttgctc

SEQ ID NO: 3816 - DNA, 31 bp, Artificial Sequence
  Single strand DNA oligonucleotide
aaactcgagtataacacaggcataaagcagc

SEQ ID NO: 3817 - DNA, 31 bp, Artificial Sequence
  Single strand DNA oligonucleotide
aaaggatccatattggaatgcttctgtcgtc

SEQ ID NO: 3818 - DNA, 31 bp, Artificial Sequence
  Single strand DNA oligonucleotide
aaactcgagtacacgataatcacaaaccacg

SEQ ID NO: 3819 - DNA, 31 bp, Artificial Sequence
  Single strand DNA oligonucleotide
aaaggatccatggtgattcggttgttgttag

SEQ ID NO: 3820 - DNA, 31 bp, Artificial Sequence
  Single strand DNA oligonucleotide
aaaggatccatcgttgaattgatggtgattc

SEQ ID NO: 3821 - DNA, 31 bp, Artificial Sequence
  Single strand DNA oligonucleotide
aaactcgagtcatacgtcgaagaaccagaac

SEQ ID NO: 3822 - DNA, 30 bp, Artificial Sequence
  Single strand DNA oligonucleotide
aaactcgagtgaaactttcgccaactacac

SEQ ID NO: 3823 - DNA, 31 bp, Artificial Sequence
  Single strand DNA oligonucleotide
aaagtcgacttctgatctgctcagctaaagg

SEQ ID NO: 3824 - DNA, 31 bp, Artificial Sequence
  Single strand DNA oligonucleotide
aaagagctcctgatgcacaaatatggtaacg

SEQ ID NO: 3825 - DNA, 31 bp, Artificial Sequence
  Single strand DNA oligonucleotide
aaaggatccccggttctatgtgtaggaagag

SEQ ID NO: 3826 - DNA, 31 bp, Artificial Sequence
  Single strand DNA oligonucleotide
aaaggatcccaggatgagtgttgatccattc

SEQ ID NO: 3827 - DNA, 31 bp, Artificial Sequence
  Single strand DNA oligonucleotide
aaaggtaccgtcacaaacgcctcaacatatc

SEQ ID NO: 3828 - DNA, 31 bp, Artificial Sequence
  Single strand DNA oligonucleotide
aaaggtaccttcaccatattgctacgaaatc

SEQ ID NO: 3829 - DNA, 30 bp, Artificial Sequence
  Single strand DNA oligonucleotide
aaagtcgacagttcaagaggctgtcctgag

SEQ ID NO: 3830 - DNA, 31 bp, Artificial Sequence
  Single strand DNA oligonucleotide
aaatctagatccaataacataagaaaccacg

SEQ ID NO: 3831 - DNA, 30 bp, Artificial Sequence
  Single strand DNA oligonucleotide
aaagtcgacaacgaaccactcttctgcatc

SEQ ID NO: 3832 - DNA, 31 bp, Artificial Sequence
  Single strand DNA oligonucleotide
aaagagctcgaagcaacctggaaataaactc

SEQ ID NO: 3833 - DNA, 29 bp, Artificial Sequence
  Single strand DNA oligonucleotide
aaagatatcctcctcagatccaccaccac

SEQ ID NO: 3834 - DNA, 31 bp, Artificial Sequence
  Single strand DNA oligonucleotide
aatctgcagctaaaatattcagggcttgttg

SEQ ID NO: 3835 - DNA, 27 bp, Artificial Sequence
  Single strand DNA oligonucleotide
aaactcgagctccagcacacggacgag

SEQ ID NO: 3836 - DNA, 31 bp, Artificial Sequence
  Single strand DNA oligonucleotide
aaagagctctacgagtacgaattattgccag

SEQ ID NO: 3837 - DNA, 30 bp, Artificial Sequence
  Single strand DNA oligonucleotide
aaaggatccacaagcgtcttcttcgtcttc

SEQ ID NO: 3838 - DNA, 31 bp, Artificial Sequence
  Single strand DNA oligonucleotide
aaaggtaccccatgccacccttactatactc

SEQ ID NO: 3839 - DNA, 30 bp, Artificial Sequence
  Single strand DNA oligonucleotide
taagtcgaccacacagagcacagcacagag

SEQ ID NO: 3840 - DNA, 26 bp, Artificial Sequence
  Single strand DNA oligonucleotide
tgagctctgaacatgcgaccgtatgc

SEQ ID NO: 3841 - DNA, 31 bp, Artificial Sequence
  Single strand DNA oligonucleotide
aaagtcgaccactagcgcacagatctcctac

SEQ ID NO: 3842 - DNA, 31 bp, Artificial Sequence
  Single strand DNA oligonucleotide
aaatctagaaatagtgtccatgagacgaacg

SEQ ID NO: 3843 - DNA, 27 bp, Artificial Sequence
  Single strand DNA oligonucleotide
aaagtcgacacgacgaggaggaggatg

SEQ ID NO: 3844 - DNA, 31 bp, Artificial Sequence
  Single strand DNA oligonucleotide
aatgatatcacgcatggatttctttaagttg

SEQ ID NO: 3845 - DNA, 29 bp, Artificial Sequence
  Single strand DNA oligonucleotide
atcggatcctagctttgcccagttttgct

SEQ ID NO: 3846 - DNA, 34 bp, Artificial Sequence
  Single strand DNA oligonucleotide
tttctcgagctatgcagttttagcctaaggcaag

SEQ ID NO: 3847 - DNA, 27 bp, Artificial Sequence
  Single strand DNA oligonucleotide
aaaggtacccgaggtcgtcacgcacag

SEQ ID NO: 3848 - DNA, 29 bp, Artificial Sequence
  Single strand DNA oligonucleotide
aatggtacctgggtggttagacagcaagg

SEQ ID NO: 3849 - DNA, 30 bp, Artificial Sequence
  Single strand DNA oligonucleotide
aaagtcgacctctggcgctctcctatactc

SEQ ID NO: 3850 - DNA, 31 bp, Artificial Sequence
  Single strand DNA oligonucleotide
aaagtcgacagtacgtgtacgtttcagggag

SEQ ID NO: 3851 - DNA, 31 bp, Artificial Sequence
  Single strand DNA oligonucleotide
aaatctagaagtaccactagcagaaaggcag

SEQ ID NO: 3852 - DNA, 31 bp, Artificial Sequence
  Single strand DNA oligonucleotide
aaatctagatggcacccaatactagtaccac

SEQ ID NO: 3853 - DNA, 29 bp, Artificial Sequence
  Single strand DNA oligonucleotide
aaaggatcccttacccttccctgagatcc

SEQ ID NO: 3854 - DNA, 34 bp, Artificial Sequence
  Single strand DNA oligonucleotide
aaactcgagctaactaccaaagttcaagcagctc

SEQ ID NO: 3855 - DNA, 32 bp, Artificial Sequence
  Single strand DNA oligonucleotide
aaagtcgacaccatgagttcataacaagaagg

SEQ ID NO: 3856 - DNA, 34 bp, Artificial Sequence
  Single strand DNA oligonucleotide
aaatctagactaatacatggaagtgcagacatgc

SEQ ID NO: 3857 - DNA, 34 bp, Artificial Sequence
  Single strand DNA oligonucleotide
aaagtcgacaggtacagtatagtatgacaccgac

SEQ ID NO: 3858 - DNA, 34 bp, Artificial Sequence
  Single strand DNA oligonucleotide
aattctagactactgttaaccgctgattatatcc

SEQ ID NO: 3859 - DNA, 32 bp, Artificial Sequence
  Single strand DNA oligonucleotide
tttgtcgacgaagaagagatgggagttttctc

SEQ ID NO: 3860 - DNA, 35 bp, Artificial Sequence
  Single strand DNA oligonucleotide
aaatctagaatttctgacattacattatagtctcg

SEQ ID NO: 3861 - DNA, 31 bp, Artificial Sequence
  Single strand DNA oligonucleotide
aaagtcgacttctcctcctacgttctactgg

SEQ ID NO: 3862 - DNA, 35 bp, Artificial Sequence
  Single strand DNA oligonucleotide
aaatctagactaacagggtttctccactaagtaag

SEQ ID NO: 3863 - DNA, 29 bp, Artificial Sequence
  Single strand DNA oligonucleotide
aaagtcgactccactataagcaacgcacc

SEQ ID NO: 3864 - DNA, 29 bp, Artificial Sequence
  Single strand DNA oligonucleotide
aaagtcgacgaaggaaactcggtgacacg

SEQ ID NO: 3865 - DNA, 32 bp, Artificial Sequence
  Single strand DNA oligonucleotide
aaatctagaatgccatgctactaagaacctac

SEQ ID NO: 3866 - DNA, 31 bp, Artificial Sequence
  Single strand DNA oligonucleotide
aaatctagataaacatctcatgccatgctac

SEQ ID NO: 3867 - DNA, 29 bp, Artificial Sequence
  Single strand DNA oligonucleotide
tttaggcctcaagatccgcagagatgatc

SEQ ID NO: 3868 - DNA, 33 bp, Artificial Sequence
  Single strand DNA oligonucleotide
aaaaggcctttaagtgcttgcgtcgttttacag

SEQ ID NO: 3869 - DNA, 27 bp, Artificial Sequence
  Single strand DNA oligonucleotide
aatctagacctcgagccacccactttc

SEQ ID NO: 3870 - DNA, 32 bp, Artificial Sequence
  Single strand DNA oligonucleotide
tgagctctcaccttcatcttgtcttcactggt

SEQ ID NO: 3871 - DNA, 31 bp, Artificial Sequence
  Single strand DNA oligonucleotide
aaagtcgacctctaccttcttcttcggtcag

SEQ ID NO: 3872 - DNA, 31 bp, Artificial Sequence
  Single strand DNA oligonucleotide
aaatctagaagcttagctaggccaacaatac

SEQ ID NO: 3873 - DNA, 30 bp, Artificial Sequence
  Single strand DNA oligonucleotide
ctagtcgacaagaaattggcacagaaatgg

SEQ ID NO: 3874 - DNA, 33 bp, Artificial Sequence
  Single strand DNA oligonucleotide
tattctagatcaaagagcctagtgagcgtcttc

SEQ ID NO: 3875 - DNA, 28 bp, Artificial Sequence
  Single strand DNA oligonucleotide
aaagtcgacaggccagaccaaaaccatg

SEQ ID NO: 3876 - DNA, 31 bp, Artificial Sequence
  Single strand DNA oligonucleotide
aaatctagaagagtaacatggacacacgacc

SEQ ID NO: 3877 - DNA, 33 bp, Artificial Sequence
  Single strand DNA oligonucleotide
aattctagatcagtacaagagccagatgtctga

SEQ ID NO: 3878 - DNA, 31 bp, Artificial Sequence
  Single strand DNA oligonucleotide
aaaggatccgagagaggagcaaagattcacc

SEQ ID NO: 3879 - DNA, 31 bp, Artificial Sequence
  Single strand DNA oligonucleotide
aaactcgagtacaggatggttggtcttcttc

SEQ ID NO: 3880 - DNA, 29 bp, Artificial Sequence
  Single strand DNA oligonucleotide
tttggatccgcatctaagccgaattgaag

SEQ ID NO: 3881 - DNA, 33 bp, Artificial Sequence
  Single strand DNA oligonucleotide
aaactcgagctatttcatgctcagtacctgcac

SEQ ID NO: 3882 - DNA, 31 bp, Artificial Sequence
  Single strand DNA oligonucleotide
aaagtcgacatccagatgcttcacattcttg

SEQ ID NO: 3883 - DNA, 31 bp, Artificial Sequence
  Single strand DNA oligonucleotide
aaatctagatcgagtttgacacgaacttatg

SEQ ID NO: 3884 - DNA, 30 bp, Artificial Sequence
  Single strand DNA oligonucleotide
aaactcgagctactccgatcggatcctgac

SEQ ID NO: 3885 - DNA, 28 bp, Artificial Sequence
  Single strand DNA oligonucleotide
aaagagctcaaacgacgcacggtctcac

SEQ ID NO: 3886 - DNA, 30 bp, Artificial Sequence
  Single strand DNA oligonucleotide
atacccgggtctctcaagatggtggtgctg

SEQ ID NO: 3887 - DNA, 30 bp, Artificial Sequence
  Single strand DNA oligonucleotide
tatggtaccaagggcttagcaaattctttc

SEQ ID NO: 3888 - DNA, 31 bp, Artificial Sequence
  Single strand DNA oligonucleotide
aaagtcgacattcttcgacctcctaaactcc

SEQ ID NO: 3889 - DNA, 31 bp, Artificial Sequence
  Single strand DNA oligonucleotide
aaagtcgacagtctcacacagatcgcttcac

SEQ ID NO: 3890 - DNA, 33 bp, Artificial Sequence
  Single strand DNA oligonucleotide
aaatctagactaccaactcagaaccaggatgag

SEQ ID NO: 3891 - DNA, 34 bp, Artificial Sequence
  Single strand DNA oligonucleotide
aaatctagacatacctataaggctataacactgc

SEQ ID NO: 3892 - DNA, 30 bp, Artificial Sequence
  Single strand DNA oligonucleotide
aaaggatccctcgtcttcgtctactccacc

SEQ ID NO: 3893 - DNA, 31 bp, Artificial Sequence
  Single strand DNA oligonucleotide
aaaggatcccctcactcgtagtctcgtcttc

SEQ ID NO: 3894 - DNA, 31 bp, Artificial Sequence
  Single strand DNA oligonucleotide
aaactcgagggagctttggagaataacaaac

SEQ ID NO: 3895 - DNA, 31 bp, Artificial Sequence
  Single strand DNA oligonucleotide
aaactcgagcaacaggtaactcatttccacc

SEQ ID NO: 3896 - DNA, 31 bp, Artificial Sequence
  Single strand DNA oligonucleotide
aaaggatcctcatcagttccctgttcttcag

SEQ ID NO: 3897 - DNA, 31 bp, Artificial Sequence
  Single strand DNA oligonucleotide
aaactcgagatgactggactaaagcaaccac

SEQ ID NO: 3898 - DNA, 30 bp, Artificial Sequence
  Single strand DNA oligonucleotide
aaaggatccctcttgctaggagtagcctgc

SEQ ID NO: 3899 - DNA, 31 bp, Artificial Sequence
  Single strand DNA oligonucleotide
aaaggtacctattatcctacatgccacatgc

SEQ ID NO: 3900 - DNA, 30 bp, Artificial Sequence
  Single strand DNA oligonucleotide
aaagtcgaccactccctcttatagcccacc

SEQ ID NO: 3901 - DNA, 32 bp, Artificial Sequence
  Single strand DNA oligonucleotide
aaatctagactaagtgtacagttcacggcacg

SEQ ID NO: 3902 - DNA, 31 bp, Artificial Sequence
  Single strand DNA oligonucleotide
aaagtcgactctcgtttctcctaccctacag

SEQ ID NO: 3903 - DNA, 35 bp, Artificial Sequence
  Single strand DNA oligonucleotide
aaatctagactaacagtttccagtcaaagctacag

SEQ ID NO: 3904 - DNA, 29 bp, Artificial Sequence
  Single strand DNA oligonucleotide
aaagtcgacctatccatccgccacaagac

SEQ ID NO: 3905 - DNA, 31 bp, Artificial Sequence
  Single strand DNA oligonucleotide
aaatctagaacacaagacaccatttctggag

SEQ ID NO: 3906 - DNA, 31 bp, Artificial Sequence
  Single strand DNA oligonucleotide
aaagtcgacaggatttctctaggatagcagc

SEQ ID NO: 3907 - DNA, 29 bp, Artificial Sequence
  Single strand DNA oligonucleotide
aaagtcgacctcagtcgagcgaggatttc

SEQ ID NO: 3908 - DNA, 31 bp, Artificial Sequence
  Single strand DNA oligonucleotide
aaactcgagaaacagagcctaacagacatgg

SEQ ID NO: 3909 - DNA, 31 bp, Artificial Sequence
  Single strand DNA oligonucleotide
aaactcgaggggatgtttagactgctacagg

SEQ ID NO: 3910 - DNA, 30 bp, Artificial Sequence
  Single strand DNA oligonucleotide
tatggatcccgacctttgataccaagcaag

SEQ ID NO: 3911 - DNA, 34 bp, Artificial Sequence
  Single strand DNA oligonucleotide
ttactcgagcacggattagtttgtagtagcatgg

SEQ ID NO: 3912 - DNA, 30 bp, Artificial Sequence
  Single strand DNA oligonucleotide
aatggatcctaaaaatggcggctgctactc

SEQ ID NO: 3913 - DNA, 33 bp, Artificial Sequence
  Single strand DNA oligonucleotide
tttgatatctcatacacggtttcatatggtcgg

SEQ ID NO: 3914 - DNA, 31 bp, Artificial Sequence
  Single strand DNA oligonucleotide
aaagtcgacatcaaaccaacgagagcactac

SEQ ID NO: 3915 - DNA, 31 bp, Artificial Sequence
  Single strand DNA oligonucleotide
aaatctagaacttcagtgtactttcccttgc

SEQ ID NO: 3916 - DNA, 31 bp, Artificial Sequence
  Single strand DNA oligonucleotide
aaaggatccaacacgacttgtgagtgagagc

SEQ ID NO: 3917 - DNA, 31 bp, Artificial Sequence
  Single strand DNA oligonucleotide
aaaggatccatatgagtaacgccatcaggag

SEQ ID NO: 3918 - DNA, 30 bp, Artificial Sequence
  Single strand DNA oligonucleotide
aaactcgagtgcctcatttaatcttgggtc

SEQ ID NO: 3919 - DNA, 31 bp, Artificial Sequence
  Single strand DNA oligonucleotide
aaactcgaggaaattgcctcatttaatcttg

SEQ ID NO: 3920 - DNA, 31 bp, Artificial Sequence
  Single strand DNA oligonucleotide
aaaggatccaattcgagatatttggctgttc

SEQ ID NO: 3921 - DNA, 31 bp, Artificial Sequence
  Single strand DNA oligonucleotide
aaaggatccagatagcaagatagtccggttg

SEQ ID NO: 3922 - DNA, 31 bp, Artificial Sequence
  Single strand DNA oligonucleotide
aaaggtaccggtctatcacaagcatcctcac

SEQ ID NO: 3923 - DNA, 31 bp, Artificial Sequence
  Single strand DNA oligonucleotide
aaaggtaccaccacctttgtgattgtttctc

SEQ ID NO: 3924 - DNA, 30 bp, Artificial Sequence
  Single strand DNA oligonucleotide
aaagtcgaccgacccaaattgacataactc

SEQ ID NO: 3925 - DNA, 31 bp, Artificial Sequence
  Single strand DNA oligonucleotide
aaatctagaatagctggaacctggtattgac

SEQ ID NO: 3926 - DNA, 29 bp, Artificial Sequence
  Single strand DNA oligonucleotide
aaaggatcccgagctagggttagggtttc

SEQ ID NO: 3927 - DNA, 31 bp, Artificial Sequence
  Single strand DNA oligonucleotide
aaactcgagcaacaactcacgctacacattc

SEQ ID NO: 3928 - DNA, 30 bp, Artificial Sequence
  Single strand DNA oligonucleotide
aaagtcgacccacgtcctagaatgaaagag

SEQ ID NO: 3929 - DNA, 28 bp, Artificial Sequence
  Single strand DNA oligonucleotide
aaagtcgacttcctctgcttcccacagc

SEQ ID NO: 3930 - DNA, 29 bp, Artificial Sequence
  Single strand DNA oligonucleotide
aaatctagactgttcattcacggttgcac

SEQ ID NO: 3931 - DNA, 31 bp, Artificial Sequence
  Single strand DNA oligonucleotide
aaatctagagcaaatctgtcgctttattagg

SEQ ID NO: 3932 - DNA, 31 bp, Artificial Sequence
  Single strand DNA oligonucleotide
aaagtcgacgagagaagagagatggtcctcc

SEQ ID NO: 3933 - DNA, 32 bp, Artificial Sequence
  Single strand DNA oligonucleotide
aaatctagattatcatgctgacttcttgccac

SEQ ID NO: 3934 - DNA, 27 bp, Artificial Sequence
  Single strand DNA oligonucleotide
aaactcgagtgagcagcgagccctaac

SEQ ID NO: 3935 - DNA, 41 bp, Artificial Sequence
  Single strand DNA oligonucleotide
tttgatatctcacactactagggagtggagtagtaacttga

SEQ ID NO: 3936 - DNA, 31 bp, Artificial Sequence
  Single strand DNA oligonucleotide
aaaggatccctagtagtgttcttcccattcg

SEQ ID NO: 3937 - DNA, 30 bp, Artificial Sequence
  Single strand DNA oligonucleotide
aaaggatccaacaatccgtcctttcatttg

SEQ ID NO: 3938 - DNA, 31 bp, Artificial Sequence
  Single strand DNA oligonucleotide
aaactcgagtaaacgacagcggtacacatac

SEQ ID NO: 3939 - DNA, 31 bp, Artificial Sequence
  Single strand DNA oligonucleotide
aaactcgagtacatctctaggcagcaaacag

SEQ ID NO: 3940 - DNA, 28 bp, Artificial Sequence
  Single strand DNA oligonucleotide
aaaggatccgaggacaccgcttgctttc

SEQ ID NO: 3941 - DNA, 31 bp, Artificial Sequence
  Single strand DNA oligonucleotide
aaactcgagaaccttggatatgaccaatcag

SEQ ID NO: 3942 - DNA, 31 bp, Artificial Sequence
  Single strand DNA oligonucleotide
aaaggatccctgttgccacatctagtggttc

SEQ ID NO: 3943 - DNA, 31 bp, Artificial Sequence
  Single strand DNA oligonucleotide
aaactcgagcacaattcagcgattatttcag

SEQ ID NO: 3944 - DNA, 27 bp, Artificial Sequence
  Single strand DNA oligonucleotide
attggatccttcatttccgccatccgt

SEQ ID NO: 3945 - DNA, 29 bp, Artificial Sequence
  Single strand DNA oligonucleotide
aaactcgagcaccatctcttgcagaaggc

SEQ ID NO: 3946 - DNA, 31 bp, Artificial Sequence
  Single strand DNA oligonucleotide
aaagatatccggtaggtagatgaaattaagg

SEQ ID NO: 3947 - DNA, 33 bp, Artificial Sequence
  Single strand DNA oligonucleotide
cgaggtaccctaatatgcaggtcagcacacaag

SEQ ID NO: 3948 - DNA, 27 bp, Artificial Sequence
  Single strand DNA oligonucleotide
atagatatcactccgaatccgacgcac

SEQ ID NO: 3949 - DNA, 29 bp, Artificial Sequence
  Single strand DNA oligonucleotide
atagatatcgagatcccaactccgaatcc

SEQ ID NO: 3950 - DNA, 31 bp, Artificial Sequence
  Single strand DNA oligonucleotide
tatggtaccctacgtaaatctcagcacatgc

SEQ ID NO: 3951 - DNA, 30 bp, Artificial Sequence
  Single strand DNA oligonucleotide
tatggtacccttctgcaacgttatttgagg

SEQ ID NO: 3952 - DNA, 29 bp, Artificial Sequence
  Single strand DNA oligonucleotide
aaaggatccactttaccgggctaccattc

SEQ ID NO: 3953 - DNA, 31 bp, Artificial Sequence
  Single strand DNA oligonucleotide
aaaggatccttacaagagcctgtgagctgag

SEQ ID NO: 3954 - DNA, 31 bp, Artificial Sequence
  Single strand DNA oligonucleotide
aaactcgagcttatctggaccacacttggac

SEQ ID NO: 3955 - DNA, 31 bp, Artificial Sequence
  Single strand DNA oligonucleotide
aaactcgagaagaaatacatagccctcctcc

SEQ ID NO: 3956 - DNA, 32 bp, Artificial Sequence
  Single strand DNA oligonucleotide
aaaggatccgcctcatctcggtttactataag

SEQ ID NO: 3957 - DNA, 31 bp, Artificial Sequence
  Single strand DNA oligonucleotide
aaactcgagaagtagacacaaaccatcctgg

SEQ ID NO: 3958 - DNA, 31 bp, Artificial Sequence
  Single strand DNA oligonucleotide
aaaggatcctctatcaaatcagccacctgtc

SEQ ID NO: 3959 - DNA, 34 bp, Artificial Sequence
  Single strand DNA oligonucleotide
aaactcgagctagcaactttgtagaccagacgtg

SEQ ID NO: 3960 - DNA, 33 bp, Artificial Sequence
  Single strand DNA oligonucleotide
aaaggatccctactaccagacagagaggacagg

SEQ ID NO: 3961 - DNA, 30 bp, Artificial Sequence
  Single strand DNA oligonucleotide
tttggatccgctttctggcatcgctactac

SEQ ID NO: 3962 - DNA, 34 bp, Artificial Sequence
  Single strand DNA oligonucleotide
tgtctcgagtcagtaggagtttatgagatgaacc

SEQ ID NO: 3963 - DNA, 35 bp, Artificial Sequence
  Single strand DNA oligonucleotide
aaactcgagtcaactcatcatccggaacatggtac

SEQ ID NO: 3964 - DNA, 30 bp, Artificial Sequence
  Single strand DNA oligonucleotide
aaactcgagaattctagcaaggcagctcag

SEQ ID NO: 3965 - DNA, 31 bp, Artificial Sequence
  Single strand DNA oligonucleotide
aaaggtacctacgtgcgtatcatacatggag

SEQ ID NO: 3966 - DNA, 28 bp, Artificial Sequence
  Single strand DNA oligonucleotide
aaaggatccactcttccaaccgctcctc

SEQ ID NO: 3967 - DNA, 31 bp, Artificial Sequence
  Single strand DNA oligonucleotide
aaaggtacccggttacaaggtatggaatcac

SEQ ID NO: 3968 - DNA, 29 bp, Artificial Sequence
  Single strand DNA oligonucleotide
aaaggatcctgcggctgagtacagacgac

SEQ ID NO: 3969 - DNA, 33 bp, Artificial Sequence
  Single strand DNA oligonucleotide
aaaggtacccatcaatccatgctaatgtagagc

SEQ ID NO: 3970 - DNA, 28 bp, Artificial Sequence
  Single strand DNA oligonucleotide
aaagatatctctcgcagcacaaagatgg

SEQ ID NO: 3971 - DNA, 34 bp, Artificial Sequence
  Single strand DNA oligonucleotide
ataggtacctcacccttagttcttcacagtggtg

SEQ ID NO: 3972 - DNA, 29 bp, Artificial Sequence
  Single strand DNA oligonucleotide
aaagtcgacctgatacccatccatccacc

SEQ ID NO: 3973 - DNA, 28 bp, Artificial Sequence
  Single strand DNA oligonucleotide
aaagtcgacactgacaaaccggacccac

SEQ ID NO: 3974 - DNA, 33 bp, Artificial Sequence
  Single strand DNA oligonucleotide
aaatctagactagcagagccgaagtagtacgag

SEQ ID NO: 3975 - DNA, 34 bp, Artificial Sequence
  Single strand DNA oligonucleotide
aaatctagactagaacgaagtagtacgagcaagc

SEQ ID NO: 3976 - DNA, 31 bp, Artificial Sequence
  Single strand DNA oligonucleotide
aaaggatcccagctcatcagaacacagaagg

SEQ ID NO: 3977 - DNA, 31 bp, Artificial Sequence
  Single strand DNA oligonucleotide
aaactcgagttcgacaatttgcaatagaaag

SEQ ID NO: 3978 - DNA, 27 bp, Artificial Sequence
  Single strand DNA oligonucleotide
aatggatccttccctcccaccgaaatg

SEQ ID NO: 3979 - DNA, 32 bp, Artificial Sequence
  Single strand DNA oligonucleotide
aaactcgaggagcatgcaaaatggactagact

SEQ ID NO: 3980 - DNA, 27 bp, Artificial Sequence
  Single strand DNA oligonucleotide
aaaggatcctagcagtctcgatggccg

SEQ ID NO: 3981 - DNA, 32 bp, Artificial Sequence
  Single strand DNA oligonucleotide
tttggtacccgagtcagcttttgtaatgatag

SEQ ID NO: 3982 - DNA, 29 bp, Artificial Sequence
  Single strand DNA oligonucleotide
aaagtcgacttagcacacatggcgtcttc

SEQ ID NO: 3983 - DNA, 29 bp, Artificial Sequence
  Single strand DNA oligonucleotide
aaagtcgaccatcggcatcttcctaactg

SEQ ID NO: 3984 - DNA, 29 bp, Artificial Sequence
  Single strand DNA oligonucleotide
aattctagataatctgtagatggctgccg

SEQ ID NO: 3985 - DNA, 32 bp, Artificial Sequence
  Single strand DNA oligonucleotide
aatcccgggtaacaacgtacatgcaagtcatc

SEQ ID NO: 3986 - DNA, 31 bp, Artificial Sequence
  Single strand DNA oligonucleotide
aaaggatcccgacttcaagcatcagactacc

SEQ ID NO: 3987 - DNA, 31 bp, Artificial Sequence
  Single strand DNA oligonucleotide
aaaggatccagcacacacatcctctaagtgc

SEQ ID NO: 3988 - DNA, 31 bp, Artificial Sequence
  Single strand DNA oligonucleotide
aaagatatcaacagcagtcacttcactcgtc

SEQ ID NO: 3989 - DNA, 31 bp, Artificial Sequence
  Single strand DNA oligonucleotide
aaagatatcaagtggtacggctgagtgtaac

SEQ ID NO: 3990 - DNA, 30 bp, Artificial Sequence
  Single strand DNA oligonucleotide
aaaggatccactgtccactgcgtctgtctc

SEQ ID NO: 3991 - DNA, 31 bp, Artificial Sequence
  Single strand DNA oligonucleotide
aaaggatccatcgttagaggctcagagtcag

SEQ ID NO: 3992 - DNA, 31 bp, Artificial Sequence
  Single strand DNA oligonucleotide
aaactcgagactacgtattacacggaggtgg

SEQ ID NO: 3993 - DNA, 31 bp, Artificial Sequence
  Single strand DNA oligonucleotide
aaactcgagtctgcagcattccttaacctac

SEQ ID NO: 3994 - DNA, 31 bp, Artificial Sequence
  Single strand DNA oligonucleotide
aaactcgagacctgcctgccactatactatc

SEQ ID NO: 3995 - DNA, 31 bp, Artificial Sequence
  Single strand DNA oligonucleotide
aaactcgagagacccgtcttaactctacctg

SEQ ID NO: 3996 - DNA, 31 bp, Artificial Sequence
  Single strand DNA oligonucleotide
aaagagctcagcaccggttgatctagaatac

SEQ ID NO: 3997 - DNA, 31 bp, Artificial Sequence
  Single strand DNA oligonucleotide
aaagagctcatttatccacgaacccatattc

SEQ ID NO: 3998 - DNA, 28 bp, Artificial Sequence
  Single strand DNA oligonucleotide
aaaggatcccaggcctcacgtgtcattc

SEQ ID NO: 3999 - DNA, 30 bp, Artificial Sequence
  Single strand DNA oligonucleotide
aaactcgaggtttccagccaaccagaacac

SEQ ID NO: 4000 - DNA, 31 bp, Artificial Sequence
  Single strand DNA oligonucleotide
aaactcgaggatccaaattggtaatgctttg

SEQ ID NO: 4001 - DNA, 29 bp, Artificial Sequence
  Single strand DNA oligonucleotide
aaaggatccgcaagcactccacttcaagc

SEQ ID NO: 4002 - DNA, 33 bp, Artificial Sequence
  Single strand DNA oligonucleotide
aaaggatccctcgaagtgtccaagaagaacaca

SEQ ID NO: 4003 - DNA, 31 bp, Artificial Sequence
  Single strand DNA oligonucleotide
taaggtaccgagctgcaaacataacgtcgag

SEQ ID NO: 4004 - DNA, 30 bp, Artificial Sequence
  Single strand DNA oligonucleotide
aaaggatcctcatctctctccctctcatcg

SEQ ID NO: 4005 - DNA, 31 bp, Artificial Sequence
  Single strand DNA oligonucleotide
aaaggtaccgtgctgcttcaactatcctctc

SEQ ID NO: 4006 - DNA, 30 bp, Artificial Sequence
  Single strand DNA oligonucleotide
aaaggatccaaattcccaatttcttcggtc

SEQ ID NO: 4007 - DNA, 31 bp, Artificial Sequence
  Single strand DNA oligonucleotide
aaactcgagagcacacacaggttcctaagag

SEQ ID NO: 4008 - DNA, 31 bp, Artificial Sequence
  Single strand DNA oligonucleotide
aaagtcgacgactaccaatccaatctcctcc

SEQ ID NO: 4009 - DNA, 33 bp, Artificial Sequence
  Single strand DNA oligonucleotide
aaatctagaagaaatgtataatcgaagtgcatc

SEQ ID NO: 4010 - DNA, 31 bp, Artificial Sequence
  Single strand DNA oligonucleotide
aaacccgggtagtggtggagagacgaaacac

SEQ ID NO: 4011 - DNA, 31 bp, Artificial Sequence
  Single strand DNA oligonucleotide
aaagagctcctacaagtgctgactgctgaag

SEQ ID NO: 4012 - DNA, 29 bp, Artificial Sequence
  Single strand DNA oligonucleotide
aaaggatcccttggtccgtctccactctc

SEQ ID NO: 4013 - DNA, 35 bp, Artificial Sequence
  Single strand DNA oligonucleotide
aaactcgagctaggattggtactcatttctttgtg

SEQ ID NO: 4014 - DNA, 31 bp, Artificial Sequence
  Single strand DNA oligonucleotide
aacgtcgactcttctctttctcttctcctcg

SEQ ID NO: 4015 - DNA, 32 bp, Artificial Sequence
  Single strand DNA oligonucleotide
atatctagacattccaaacattgttatcaaac

SEQ ID NO: 4016 - DNA, 30 bp, Artificial Sequence
  Single strand DNA oligonucleotide
aaaggatcctactgtaagcagtttcccacc

SEQ ID NO: 4017 - DNA, 30 bp, Artificial Sequence
  Single strand DNA oligonucleotide
aaaggatccaacaacgctcgtactgtaagc

SEQ ID NO: 4018 - DNA, 31 bp, Artificial Sequence
  Single strand DNA oligonucleotide
aaaggtaccacaagtcattctaccaagcacc

SEQ ID NO: 4019 - DNA, 31 bp, Artificial Sequence
  Single strand DNA oligonucleotide
aaaggtaccatactttccttgctctgctgtc

SEQ ID NO: 4020 - DNA, 28 bp, Artificial Sequence
  Single strand DNA oligonucleotide
aaaggatccaaacggttgggaggttagc

SEQ ID NO: 4021 - DNA, 31 bp, Artificial Sequence
  Single strand DNA oligonucleotide
aaactcgagactggatcagattgtgaaggtg

SEQ ID NO: 4022 - DNA, 27 bp, Artificial Sequence
  Single strand DNA oligonucleotide
aaaggatccacgactccgacgagcgac

SEQ ID NO: 4023 - DNA, 31 bp, Artificial Sequence
  Single strand DNA oligonucleotide
aaactcgagaactcaagtggacaaatgttgc

SEQ ID NO: 4024 - DNA, 29 bp, Artificial Sequence
  Single strand DNA oligonucleotide
aaaggatccagaagcgtagagcggtcaag

SEQ ID NO: 4025 - DNA, 31 bp, Artificial Sequence
  Single strand DNA oligonucleotide
aaactcgagcattaagcgaattaaccatgtg

SEQ ID NO: 4026 - DNA, 32 bp, Artificial Sequence
  Single strand DNA oligonucleotide
aaaggatccgctagctactagcaaattgaagc

SEQ ID NO: 4027 - DNA, 30 bp, Artificial Sequence
  Single strand DNA oligonucleotide
aaaggtaccggtcacccgttagacttatgc

SEQ ID NO: 4028 - DNA, 31 bp, Artificial Sequence
  Single strand DNA oligonucleotide
aaaggtacctggtaaattatgggtattcagc

SEQ ID NO: 4029 - DNA, 27 bp, Artificial Sequence
  Single strand DNA oligonucleotide
aaaggatccaccaccgctcgtctccac

SEQ ID NO: 4030 - DNA, 31 bp, Artificial Sequence
  Single strand DNA oligonucleotide
aaagatatcacaagagagatggtgtgtcagc

SEQ ID NO: 4031 - DNA, 30 bp, Artificial Sequence
  Single strand DNA oligonucleotide
aaaggatccgggtgtcatcaaacggactac

SEQ ID NO: 4032 - DNA, 33 bp, Artificial Sequence
  Single strand DNA oligonucleotide
aaaggtaccctaaacgaggttacggaatgtgtc

SEQ ID NO: 4033 - DNA, 28 bp, Artificial Sequence
  Single strand DNA oligonucleotide
aaagtcgacggaattggtgaggtgatgc

SEQ ID NO: 4034 - DNA, 32 bp, Artificial Sequence
  Single strand DNA oligonucleotide
aaatctagacagataaacctcaatcaaagtcg

SEQ ID NO: 4035 - DNA, 32 bp, Artificial Sequence
  Single strand DNA oligonucleotide
aaagtcgacctgtcctctactacgcatctctc

SEQ ID NO: 4036 - DNA, 31 bp, Artificial Sequence
  Single strand DNA oligonucleotide
aaatctagataatcatcattgtagcaggcac

SEQ ID NO: 4037 - DNA, 30 bp, Artificial Sequence
  Single strand DNA oligonucleotide
aaaggatcctaggaaggatggtactggctg

SEQ ID NO: 4038 - DNA, 30 bp, Artificial Sequence
  Single strand DNA oligonucleotide
aaaggatccgcgataggaaggatggtactg

SEQ ID NO: 4039 - DNA, 31 bp, Artificial Sequence
  Single strand DNA oligonucleotide
aaaggtaccaggcaaacacaatgatttcaac

SEQ ID NO: 4040 - DNA, 30 bp, Artificial Sequence
  Single strand DNA oligonucleotide
aaaggtacctgtaacataagtaccgggcag

SEQ ID NO: 4041 - DNA, 28 bp, Artificial Sequence
  Single strand DNA oligonucleotide
aaagtcgacaatctcccacgctccaaag

SEQ ID NO: 4042 - DNA, 31 bp, Artificial Sequence
  Single strand DNA oligonucleotide
aaatctagaagttacattcttgaccagcagc

SEQ ID NO: 4043 - DNA, 34 bp, Artificial Sequence
  Single strand DNA oligonucleotide
aaaggatcccttctagtagcacagtagtagcagc

SEQ ID NO: 4044 - DNA, 31 bp, Artificial Sequence
  Single strand DNA oligonucleotide
aaactcgagaacgaggaagaatcggtatatg

SEQ ID NO: 4045 - DNA, 30 bp, Artificial Sequence
  Single strand DNA oligonucleotide
aaaggatccggaacaactcgtagccatgac

SEQ ID NO: 4046 - DNA, 31 bp, Artificial Sequence
  Single strand DNA oligonucleotide
tatggatcccaatttgagagcatttgctacg

SEQ ID NO: 4047 - DNA, 34 bp, Artificial Sequence
  Single strand DNA oligonucleotide
taactcgagctgaacttaatagcaattccgtagc

SEQ ID NO: 4048 - DNA, 30 bp, Artificial Sequence
  Single strand DNA oligonucleotide
aaactcgagcgcactactgtgcttctgaac

SEQ ID NO: 4049 - DNA, 30 bp, Artificial Sequence
  Single strand DNA oligonucleotide
aaagtcgacttgctccctctctctctcttg

SEQ ID NO: 4050 - DNA, 31 bp, Artificial Sequence
  Single strand DNA oligonucleotide
aaatctagatgtattcacgaggtaaacaacg

SEQ ID NO: 4051 - DNA, 31 bp, Artificial Sequence
  Single strand DNA oligonucleotide
aaaggatccgagagattaattaagtggcagg

SEQ ID NO: 4052 - DNA, 34 bp, Artificial Sequence
  Single strand DNA oligonucleotide
aaaggatccagaagagagattaattaagtggcag

SEQ ID NO: 4053 - DNA, 35 bp, Artificial Sequence
  Single strand DNA oligonucleotide
aaaggtaccctaatatcgatccaaactcacacaag

SEQ ID NO: 4054 - DNA, 30 bp, Artificial Sequence
  Single strand DNA oligonucleotide
aatcccgggtcgagaggtttcattcagtgc

SEQ ID NO: 4055 - DNA, 31 bp, Artificial Sequence
  Single strand DNA oligonucleotide
tttggtaccttattacatttggatgggctgt

SEQ ID NO: 4056 - DNA, 28 bp, Artificial Sequence
  Single strand DNA oligonucleotide
aaagtcgacgagcacaggtagggtttcg

SEQ ID NO: 4057 - DNA, 31 bp, Artificial Sequence
  Single strand DNA oligonucleotide
aaagatatccactaccgaagactcacacgac

SEQ ID NO: 4058 - DNA, 27 bp, Artificial Sequence
  Single strand DNA oligonucleotide
aaactcgagaaccctcgcgaatctgag

SEQ ID NO: 4059 - DNA, 31 bp, Artificial Sequence
  Single strand DNA oligonucleotide
aaagatatctagttctccattcagcatctcc

SEQ ID NO: 4060 - DNA, 28 bp, Artificial Sequence
  Single strand DNA oligonucleotide
aaaggatccaaagcagttccagccttcc

SEQ ID NO: 4061 - DNA, 28 bp, Artificial Sequence
  Single strand DNA oligonucleotide
aaaggatccaccaatggctgcctgagac

SEQ ID NO: 4062 - DNA, 31 bp, Artificial Sequence
  Single strand DNA oligonucleotide
aaactcgaggattggatatgccacttgattg

SEQ ID NO: 4063 - DNA, 31 bp, Artificial Sequence
  Single strand DNA oligonucleotide
aaaggatcccaccttcttcccagatcaatag

SEQ ID NO: 4064 - DNA, 33 bp, Artificial Sequence
  Single strand DNA oligonucleotide
aaactcgaggaaacaaagcacagtcagtagtag

SEQ ID NO: 4065 - DNA, 34 bp, Artificial Sequence
  Single strand DNA oligonucleotide
aaaggatcctactaacaaacagataatctccacg

SEQ ID NO: 4066 - DNA, 32 bp, Artificial Sequence
  Single strand DNA oligonucleotide
atactcgagaacatgttggagatctttgatgc

SEQ ID NO: 4067 - DNA, 31 bp, Artificial Sequence
  Single strand DNA oligonucleotide
aaaggatccgagaagctccactcttctccac

SEQ ID NO: 4068 - DNA, 31 bp, Artificial Sequence
  Single strand DNA oligonucleotide
aaactcgagtataatgcacagttatgggcag

SEQ ID NO: 4069 - DNA, 30 bp, Artificial Sequence
  Single strand DNA oligonucleotide
aaagtcgactcaacgcccaagctagattac

SEQ ID NO: 4070 - DNA, 31 bp, Artificial Sequence
  Single strand DNA oligonucleotide
aaagagctcctcaacattgcaacaactatgg

SEQ ID NO: 4071 - DNA, 30 bp, Artificial Sequence
  Single strand DNA oligonucleotide
aaagtcgacgcagccacacaacactatctc

SEQ ID NO: 4072 - DNA, 32 bp, Artificial Sequence
  Single strand DNA oligonucleotide
aaagagctcttgacgatacatagcacataagg

SEQ ID NO: 4073 - DNA, 27 bp, Artificial Sequence
  Single strand DNA oligonucleotide
tttcccgggtgccacttgtgcgaggag

SEQ ID NO: 4074 - DNA, 35 bp, Artificial Sequence
  Single strand DNA oligonucleotide
aacggtacctcaccaatcaaaatgtacaatcatgt

SEQ ID NO: 4075 - DNA, 29 bp, Artificial Sequence
  Single strand DNA oligonucleotide
aaaggatccgagcaaccacccgtagtcag

SEQ ID NO: 4076 - DNA, 31 bp, Artificial Sequence
  Single strand DNA oligonucleotide
aaaggtaccacagctcaagtgctcatttctc

SEQ ID NO: 4077 - DNA, 27 bp, Artificial Sequence
  Single strand DNA oligonucleotide
aaactcgagccgccatctactcggagc

SEQ ID NO: 4078 - DNA, 28 bp, Artificial Sequence
  Single strand DNA oligonucleotide
aaactcgagcctcctccgccatctactc

SEQ ID NO: 4079 - DNA, 31 bp, Artificial Sequence
  Single strand DNA oligonucleotide
aaagatatcagaattcacactgtcccaacac

SEQ ID NO: 4080 - DNA, 31 bp, Artificial Sequence
  Single strand DNA oligonucleotide
aaagatatccagttattataggcctcgttcc

SEQ ID NO: 4081 - DNA, 31 bp, Artificial Sequence
  Single strand DNA oligonucleotide
aaactcgagtgattgcgtttccttaaatatg

SEQ ID NO: 4082 - DNA, 31 bp, Artificial Sequence
  Single strand DNA oligonucleotide
aaagatatccaatcaatcctacaaacacagc

SEQ ID NO: 4083 - DNA, 31 bp, Artificial Sequence
  Single strand DNA oligonucleotide
aaactcgagtgttaggaagtgaggactgagc

SEQ ID NO: 4084 - DNA, 32 bp, Artificial Sequence
  Single strand DNA oligonucleotide
aaagagctcgctcaattattcaccatttcatc

SEQ ID NO: 4085 - DNA, 29 bp, Artificial Sequence
  Single strand DNA oligonucleotide
aaagtcgacgcacaacccttggagacttc

SEQ ID NO: 4086 - DNA, 31 bp, Artificial Sequence
  Single strand DNA oligonucleotide
aaatctagatcctctcatcgagctaagacac

SEQ ID NO: 4087 - DNA, 28 bp, Artificial Sequence
  Single strand DNA oligonucleotide
aaaggatccatccggatctccacattcc

SEQ ID NO: 4088 - DNA, 31 bp, Artificial Sequence
  Single strand DNA oligonucleotide
aaaggtaccgaaacaatctcatggtctctgc

SEQ ID NO: 4089 - DNA, 31 bp, Artificial Sequence
  Single strand DNA oligonucleotide
aaagtcgacactgagctctctgctaagttgg

SEQ ID NO: 4090 - DNA, 31 bp, Artificial Sequence
  Single strand DNA oligonucleotide
aaaggatcctcctagcaacagaagatccaag

SEQ ID NO: 4091 - DNA, 29 bp, Artificial Sequence
  Single strand DNA oligonucleotide
aaactcgagagcttcctccctagctgtcc

SEQ ID NO: 4092 - DNA, 30 bp, Artificial Sequence
  Single strand DNA oligonucleotide
aaactcgaggtgtagcttcctccctagctg

SEQ ID NO: 4093 - DNA, 35 bp, Artificial Sequence
  Single strand DNA oligonucleotide
aaagagctcctattccaggagaagaacaataagag

SEQ ID NO: 4094 - DNA, 33 bp, Artificial Sequence
  Single strand DNA oligonucleotide
aaagagctcctattcatgttccaggagaagaac

SEQ ID NO: 4095 - DNA, 31 bp, Artificial Sequence
  Single strand DNA oligonucleotide
aatctcgagatttatctgcttcaatggcaac

SEQ ID NO: 4096 - DNA, 30 bp, Artificial Sequence
  Single strand DNA oligonucleotide
ataggtaccctaagcatcattctgcctacc

SEQ ID NO: 4097 - DNA, 30 bp, Artificial Sequence
  Single strand DNA oligonucleotide
aaagtcgaccctccatccttcagtaattgg

SEQ ID NO: 4098 - DNA, 34 bp, Artificial Sequence
  Single strand DNA oligonucleotide
tttctcgagtcagtctccttggatgtttgagttg

SEQ ID NO: 4099 - DNA, 30 bp, Artificial Sequence
  Single strand DNA oligonucleotide
aaggtcgacactcccaacgtctactcttcc

SEQ ID NO: 4100 - DNA, 30 bp, Artificial Sequence
  Single strand DNA oligonucleotide
aatgtcgacctcaccactcccaacgtctac

SEQ ID NO: 4101 - DNA, 34 bp, Artificial Sequence
  Single strand DNA oligonucleotide
aaactcgagatgtaagaatgaaatcttgtagctc

SEQ ID NO: 4102 - DNA, 32 bp, Artificial Sequence
  Single strand DNA oligonucleotide
aatctcgagtgcaaggatgtaagaatgaaatc

SEQ ID NO: 4103 - DNA, 32 bp, Artificial Sequence
  Single strand DNA oligonucleotide
aaaggatccgagataattagctcactccatgg

SEQ ID NO: 4104 - DNA, 28 bp, Artificial Sequence
  Single strand DNA oligonucleotide
tatggtaccgaattgggcctatgagacg

SEQ ID NO: 4105 - DNA, 30 bp, Artificial Sequence
  Single strand DNA oligonucleotide
aaagtcgacaacacctctctggctctctcc

SEQ ID NO: 4106 - DNA, 31 bp, Artificial Sequence
  Single strand DNA oligonucleotide
aaagagctctcctaagactttctcagccatc

SEQ ID NO: 4107 - DNA, 28 bp, Artificial Sequence
  Single strand DNA oligonucleotide
aaagatatcacctcgaaaccctagatcg

SEQ ID NO: 4108 - DNA, 28 bp, Artificial Sequence
  Single strand DNA oligonucleotide
aaagatatcattcctcgaccagctcacg

SEQ ID NO: 4109 - DNA, 30 bp, Artificial Sequence
  Single strand DNA oligonucleotide
ttaggtaccactcaaaggagagcttcagcc

SEQ ID NO: 4110 - DNA, 29 bp, Artificial Sequence
  Single strand DNA oligonucleotide
taaggtaccgttggcattcttcaaaccag

SEQ ID NO: 4111 - DNA, 29 bp, Artificial Sequence
  Single strand DNA oligonucleotide
aaagtcgacctcgagagctcaatgattcg

SEQ ID NO: 4112 - DNA, 31 bp, Artificial Sequence
  Single strand DNA oligonucleotide
aaatctagaaccaaccaattaaaggctaatg

SEQ ID NO: 4113 - DNA, 28 bp, Artificial Sequence
  Single strand DNA oligonucleotide
aaagtcgacgattggttgcttgggtttg

SEQ ID NO: 4114 - DNA, 31 bp, Artificial Sequence
  Single strand DNA oligonucleotide
aaatctagatgctttctttcagaacatctcc

SEQ ID NO: 4115 - DNA, 30 bp, Artificial Sequence
  Single strand DNA oligonucleotide
aaagtcgacaacctctcctcctcgtcacac

SEQ ID NO: 4116 - DNA, 30 bp, Artificial Sequence
  Single strand DNA oligonucleotide
aaagtcgacatcaaacctctcctcctcgtc

SEQ ID NO: 4117 - DNA, 34 bp, Artificial Sequence
  Single strand DNA oligonucleotide
aattctagatcacaggaaggaggggtagtaacag

SEQ ID NO: 4118 - DNA, 31 bp, Artificial Sequence
  Single strand DNA oligonucleotide
aaatctagaatttcctgctgttcattcaaag

SEQ ID NO: 4119 - DNA, 31 bp, Artificial Sequence
  Single strand DNA oligonucleotide
aaagtcgactcagtgttcttccattctttcc

SEQ ID NO: 4120 - DNA, 30 bp, Artificial Sequence
  Single strand DNA oligonucleotide
aaatctagattgaattagcagcagcaagag

SEQ ID NO: 4121 - DNA, 32 bp, Artificial Sequence
  Single strand DNA oligonucleotide
aaagtcgaccgaactaactaaccatctcatcc

SEQ ID NO: 4122 - DNA, 31 bp, Artificial Sequence
  Single strand DNA oligonucleotide
aaatctagaatcgttcgattattattgctcc

SEQ ID NO: 4123 - DNA, 31 bp, Artificial Sequence
  Single strand DNA oligonucleotide
aaagatatctcctcttctcaaactccatctc

SEQ ID NO: 4124 - DNA, 31 bp, Artificial Sequence
  Single strand DNA oligonucleotide
aatctgcagggtcctgtcatgctgtgtagtc

SEQ ID NO: 4125 - DNA, 29 bp, Artificial Sequence
  Single strand DNA oligonucleotide
aaagtcgacaattcacctcccaagcagag

SEQ ID NO: 4126 - DNA, 31 bp, Artificial Sequence
  Single strand DNA oligonucleotide
aaatctagaatacaaggcctgcactacctac

SEQ ID NO: 4127 - DNA, 29 bp, Artificial Sequence
  Single strand DNA oligonucleotide
aaactcgagaaacccgataagaaaatggc

SEQ ID NO: 4128 - DNA, 32 bp, Artificial Sequence
  Single strand DNA oligonucleotide
tttgatatcctagtgccatacgtgcctaacct

SEQ ID NO: 4129 - DNA, 31 bp, Artificial Sequence
  Single strand DNA oligonucleotide
aaagtcgacatcctctctttccactcctagc

SEQ ID NO: 4130 - DNA, 31 bp, Artificial Sequence
  Single strand DNA oligonucleotide
aaatctagatagcactcagcttaattggatg

SEQ ID NO: 4131 - DNA, 27 bp, Artificial Sequence
  Single strand DNA oligonucleotide
aaagtcgacctcgcttgcccactcctt

SEQ ID NO: 4132 - DNA, 34 bp, Artificial Sequence
  Single strand DNA oligonucleotide
aaatctagactagcatgatcctggatgtttactc

SEQ ID NO: 4133 - DNA, 31 bp, Artificial Sequence
  Single strand DNA oligonucleotide
aaatctagaagcagagataggcataagtcca

SEQ ID NO: 4134 - DNA, 31 bp, Artificial Sequence
  Single strand DNA oligonucleotide
aaagatatcaccactaggactcaacgagaag

SEQ ID NO: 4135 - DNA, 32 bp, Artificial Sequence
  Single strand DNA oligonucleotide
aacctcgagagtaacatccgaacgtatacacc

SEQ ID NO: 4136 - DNA, 27 bp, Artificial Sequence
  Single strand DNA oligonucleotide
atacccgggaaccacgcgaagacatgg

SEQ ID NO: 4137 - DNA, 34 bp, Artificial Sequence
  Single strand DNA oligonucleotide
tatggtaccggatcaggttatacttcttattgac

SEQ ID NO: 4138 - DNA, 30 bp, Artificial Sequence
  Single strand DNA oligonucleotide
aaaggatccaagcctgttctctgtcgattg

SEQ ID NO: 4139 - DNA, 31 bp, Artificial Sequence
  Single strand DNA oligonucleotide
aaactcgagaatgcatgtcctagtctttacg

SEQ ID NO: 4140 - DNA, 29 bp, Artificial Sequence
  Single strand DNA oligonucleotide
ttaggatccaacatttacgcgatccattg

SEQ ID NO: 4141 - DNA, 31 bp, Artificial Sequence
  Single strand DNA oligonucleotide
ttaggatccatcatctgctttgtctacctcg

SEQ ID NO: 4142 - DNA, 34 bp, Artificial Sequence
  Single strand DNA oligonucleotide
atcggtacctcaactgaattcgctgaaacttgtc

SEQ ID NO: 4143 - DNA, 31 bp, Artificial Sequence
  Single strand DNA oligonucleotide
aaaggtaccgaaaacaaatggaagcaatctg

SEQ ID NO: 4144 - DNA, 30 bp, Artificial Sequence
  Single strand DNA oligonucleotide
aaagatatcgagacgcaagaaacatagctc

SEQ ID NO: 4145 - DNA, 30 bp, Artificial Sequence
  Single strand DNA oligonucleotide
aaactcgagcaatcactgctacaaatccgt

SEQ ID NO: 4146 - DNA, 31 bp, Artificial Sequence
  Single strand DNA oligonucleotide
tatgtcgactcttcttcactgaggcaagttc

SEQ ID NO: 4147 - DNA, 33 bp, Artificial Sequence
  Single strand DNA oligonucleotide
aagtctagatcaaagatccataacattccatgc

SEQ ID NO: 4148 - DNA, 31 bp, Artificial Sequence
  Single strand DNA oligonucleotide
attgtcgacttgagataaaggcaaaattacg

SEQ ID NO: 4149 - DNA, 31 bp, Artificial Sequence
  Single strand DNA oligonucleotide
tttgtcgacgtctcgtttcagattcttctgc

SEQ ID NO: 4150 - DNA, 31 bp, Artificial Sequence
  Single strand DNA oligonucleotide
ttcctcgagtctctagagttgcattccttcc

SEQ ID NO: 4151 - DNA, 31 bp, Artificial Sequence
  Single strand DNA oligonucleotide
tgactcgagcatcgtttacactgaaccactg

SEQ ID NO: 4152 - DNA, 30 bp, Artificial Sequence
  Single strand DNA oligonucleotide
aaagtcgacacccaggaacacatcatcatc

SEQ ID NO: 4153 - DNA, 31 bp, Artificial Sequence
  Single strand DNA oligonucleotide
aaatctagaaggacacgtcaaatgagaaaac

SEQ ID NO: 4154 - DNA, 30 bp, Artificial Sequence
  Single strand DNA oligonucleotide
aaagtcgacagtcagatccattcctcctcc

SEQ ID NO: 4155 - DNA, 29 bp, Artificial Sequence
  Single strand DNA oligonucleotide
aattctagaaaaagtagcagccggtcatc

SEQ ID NO: 4156 - DNA, 30 bp, Artificial Sequence
  Single strand DNA oligonucleotide
aacgtcgacaatcttgacaccatctcgctc

SEQ ID NO: 4157 - DNA, 31 bp, Artificial Sequence
  Single strand DNA oligonucleotide
tttaggcctctcgcacattattttgtacagc

SEQ ID NO: 4158 - DNA, 28 bp, Artificial Sequence
  Single strand DNA oligonucleotide
aaagtcgacgcgacagagaatccatggc

SEQ ID NO: 4159 - DNA, 34 bp, Artificial Sequence
  Single strand DNA oligonucleotide
aattctagatcaaactcctcttatatgcacctgc

SEQ ID NO: 4160 - DNA, 37 bp, Artificial Sequence
  Single strand DNA oligonucleotide
aaatctagatcagaaactaactcctcttatatgcacc

SEQ ID NO: 4161 - DNA, 30 bp, Artificial Sequence
  Single strand DNA oligonucleotide
atactcgagcttccccgatagaaatccatc

SEQ ID NO: 4162 - DNA, 29 bp, Artificial Sequence
  Single strand DNA oligonucleotide
tagggtaccaccaaacagcacatatgcgg

SEQ ID NO: 4163 - DNA, 27 bp, Artificial Sequence
  Single strand DNA oligonucleotide
aaagtcgaccgcaaccggagagaaatc

SEQ ID NO: 4164 - DNA, 31 bp, Artificial Sequence
  Single strand DNA oligonucleotide
aaatctagatcgacaatcttcatacacaacg

SEQ ID NO: 4165 - DNA, 30 bp, Artificial Sequence
  Single strand DNA oligonucleotide
aaaggatcccgacagtcaccactcaccaac

SEQ ID NO: 4166 - DNA, 27 bp, Artificial Sequence
  Single strand DNA oligonucleotide
aaaggatcctccgcacgcaactcagtg

SEQ ID NO: 4167 - DNA, 31 bp, Artificial Sequence
  Single strand DNA oligonucleotide
aaactcgagcaacggtaacacacaagcattc

SEQ ID NO: 4168 - DNA, 28 bp, Artificial Sequence
  Single strand DNA oligonucleotide
aaaggatccacccagaacccgaagaatg

SEQ ID NO: 4169 - DNA, 31 bp, Artificial Sequence
  Single strand DNA oligonucleotide
aatggatcctaaacccagaacccgaagaatg

SEQ ID NO: 4170 - DNA, 32 bp, Artificial Sequence
  Single strand DNA oligonucleotide
aaactcgagcaaactggagcatagcaactagg

SEQ ID NO: 4171 - DNA, 29 bp, Artificial Sequence
  Single strand DNA oligonucleotide
aaaggatcccacacaccacagtcgcaatc

SEQ ID NO: 4172 - DNA, 31 bp, Artificial Sequence
  Single strand DNA oligonucleotide
aaactcgagagaatcgatgcaggtaactacg

SEQ ID NO: 4173 - DNA, 32 bp, Artificial Sequence
  Single strand DNA oligonucleotide
aaaggatccacaataaacaagataaatggagg

SEQ ID NO: 4174 - DNA, 29 bp, Artificial Sequence
  Single strand DNA oligonucleotide
aaactcgagtcacacgcaacttcaggttc

SEQ ID NO: 4175 - DNA, 31 bp, Artificial Sequence
  Single strand DNA oligonucleotide
aaactcgagcaaaccgaattattacatcagg

SEQ ID NO: 4176 - DNA, 30 bp, Artificial Sequence
  Single strand DNA oligonucleotide
aaagtcgacggccgacacatctgatctaac

SEQ ID NO: 4177 - DNA, 33 bp, Artificial Sequence
  Single strand DNA oligonucleotide
aaagagctctcccagaaatatataagaacaagc

SEQ ID NO: 4178 - DNA, 27 bp, Artificial Sequence
  Single strand DNA oligonucleotide
aaagtcgacaactccccaaccaagcag

SEQ ID NO: 4179 - DNA, 33 bp, Artificial Sequence
  Single strand DNA oligonucleotide
aaatctagattagtactaagagtcggctttggc

SEQ ID NO: 4180 - DNA, 31 bp, Artificial Sequence
  Single strand DNA oligonucleotide
aaagtcgacctaaaccctaaccctagattgg

SEQ ID NO: 4181 - DNA, 31 bp, Artificial Sequence
  Single strand DNA oligonucleotide
aaatctagaagacttggctaatgctaacctg

SEQ ID NO: 4182 - DNA, 28 bp, Artificial Sequence
  Single strand DNA oligonucleotide
taagtcgaccgtctctcaagctcgcagc

SEQ ID NO: 4183 - DNA, 32 bp, Artificial Sequence
  Single strand DNA oligonucleotide
atttctagacgagagcctctaatggatcacag

SEQ ID NO: 4184 - DNA, 28 bp, Artificial Sequence
  Single strand DNA oligonucleotide
aaagtcgacattgcactgcatagggctg

SEQ ID NO: 4185 - DNA, 36 bp, Artificial Sequence
  Single strand DNA oligonucleotide
aaatctagactaagagttgagcatgataaatacgac

SEQ ID NO: 4186 - DNA, 31 bp, Artificial Sequence
  Single strand DNA oligonucleotide
atagtcgacgagaaagtggaagagaacatgg

SEQ ID NO: 4187 - DNA, 28 bp, Artificial Sequence
  Single strand DNA oligonucleotide
aaagtcgacccgctggagaaagtggaag

SEQ ID NO: 4188 - DNA, 31 bp, Artificial Sequence
  Single strand DNA oligonucleotide
aaatctagagtccacagatccatgtcaaatc

SEQ ID NO: 4189 - DNA, 31 bp, Artificial Sequence
  Single strand DNA oligonucleotide
aaatctagagtgaatttgatttattgccaac

SEQ ID NO: 4190 - DNA, 27 bp, Artificial Sequence
  Single strand DNA oligonucleotide
aaaggatccccgaccacggattgattc

SEQ ID NO: 4191 - DNA, 29 bp, Artificial Sequence
  Single strand DNA oligonucleotide
aaaggatccttgacttgggtgtctggtcc

SEQ ID NO: 4192 - DNA, 31 bp, Artificial Sequence
  Single strand DNA oligonucleotide
aaaggtaccgtgcctatgtcttcctagcatc

SEQ ID NO: 4193 - DNA, 31 bp, Artificial Sequence
  Single strand DNA oligonucleotide
aaaggtaccatatttaggcgccagtaaagac

SEQ ID NO: 4194 - DNA, 277 bp, Artificial Sequence
  Single strand DNA oligonucleotide
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 4195 - DNA, 2322 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 4196 - DNA, 877 bp, Artificial Sequence
  Single strand DNA oligonucleotide
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 4197 - DNA, 1127 bp, Artificial Sequence
  Single strand DNA oligonucleotide
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 4198 - DNA, 2318 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 4199 - DNA, 30 bp, Artificial Sequence
  Single strand DNA oligonucleotide
aaagatatctaaaggagtcgtagccctctc

SEQ ID NO: 4200 - DNA, 29 bp, Artificial Sequence
  Single strand DNA oligonucleotide
aaaggtaccctagtcttgcgaagtgcgag

SEQ ID NO: 4201 - DNA, 30 bp, Artificial Sequence
  Single strand DNA oligonucleotide
aaagtcgaccgaccgatccaagtagtgagc

SEQ ID NO: 4202 - DNA, 30 bp, Artificial Sequence
  Single strand DNA oligonucleotide
aaatctagaagctgataggccagtcaatcc

SEQ ID NO: 4203 - DNA, 30 bp, Artificial Sequence
  Single strand DNA oligonucleotide
aaagtcgacaaagttagcgaccaagaaacc

SEQ ID NO: 4204 - DNA, 31 bp, Artificial Sequence
  Single strand DNA oligonucleotide
aaatctagacatttcttttggatggatgaac
